(12) United States Patent
Scheid et al.

(10) Patent No.: US 9,783,594 B2
(45) Date of Patent: Oct. 10, 2017

(54) HUMAN IMMUNODEFICIENCY VIRUS NEUTRALIZING ANTIBODIES AND METHODS OF USE THEREOF

(75) Inventors: Johannes Scheid, New York, NY (US); Michel Nussenzweig, New York, NY (US); Pamela J. Bjorkman, La Canada Flintridge, CA (US); Ron Diskin, Rehovot (IL)

(73) Assignees: The Rockefeller University, New York, NY (US); California Institute of Technology, Pasadena, CA (US)

( * ) Notice: Subject to any disclaimer, the term of this patent is extended or adjusted under 35 U.S.C. 154(b) by 13 days.

(21) Appl. No.: 14/118,496

(22) PCT Filed: May 17, 2012

(86) PCT No.: PCT/US2012/038400
§ 371 (c)(1),
(2), (4) Date: Jul. 25, 2014

(87) PCT Pub. No.: WO2012/158948
PCT Pub. Date: Nov. 22, 2012

(65) Prior Publication Data
US 2014/0328862 A1 Nov. 6, 2014

Related U.S. Application Data

(60) Provisional application No. 61/486,960, filed on May 17, 2011.

(51) Int. Cl.
C07K 16/10 (2006.01)
G01N 33/569 (2006.01)
A61K 39/00 (2006.01)

(52) U.S. Cl.
CPC ...... *C07K 16/1045* (2013.01); *C07K 16/1063* (2013.01); *G01N 33/56983* (2013.01); *A61K 2039/505* (2013.01); *C07K 2317/10* (2013.01); *C07K 2317/21* (2013.01); *C07K 2317/34* (2013.01); *C07K 2317/55* (2013.01);
(Continued)

(58) Field of Classification Search
None
See application file for complete search history.

(56) References Cited

U.S. PATENT DOCUMENTS 6,228,361 B1   5/2001  Posner
6,465,172 B1  10/2002  Devico et al.
(Continued)

FOREIGN PATENT DOCUMENTS

WO        02/068649 A2    9/2002

OTHER PUBLICATIONS

Scheid et al. Sequence and Structural Convergence of Broad and Potent HIV Antibodies That Mimic CD4 Binding. Science. 2011; 333(6049): 1633-1637.*
(Continued)

*Primary Examiner* — Janet L Andres
*Assistant Examiner* — Stuart W Snyder
(74) *Attorney, Agent, or Firm* — Fox Rothschild LLP

(57) ABSTRACT

The invention provides broadly neutralizing antibodies directed to epitopes of Human Immunodeficiency Virus, or HIV. The invention further provides compositions containing HIV antibodies used for prophylaxis, and methods for diagnosis and treatment of HIV infection.

13 Claims, 25 Drawing Sheets

(52) U.S. Cl.
CPC ...... *C07K 2317/56* (2013.01); *C07K 2317/76* (2013.01); *C07K 2317/92* (2013.01)

(56) References Cited

U.S. PATENT DOCUMENTS

| | | | |
|---|---|---|---|
| 2003/0223994 | A1 | 12/2003 | Hoogenboom et al. |
| 2004/0005667 | A1 | 1/2004 | Ratti et al. |
| 2005/0288864 | A1 | 12/2005 | Cattaneo et al. |
| 2008/0050754 | A1* | 2/2008 | Yamada et al. ............... 435/7.5 |
| 2008/0193465 | A1 | 8/2008 | Dimitrov et al. |
| 2009/0155164 | A1 | 6/2009 | Brasel et al. |
| 2009/0170792 | A1 | 7/2009 | Hart et al. |
| 2009/0202568 | A1 | 8/2009 | Eriksson et al. |
| 2009/0226922 | A1 | 9/2009 | Grawunder et al. |
| 2011/0091475 | A1 | 4/2011 | Pass et al. |

OTHER PUBLICATIONS

Brekke and Sandlie (Therapeutic Antibodies for Human Diseases at the Dawn of the Twenty-First Century. Nature: Drug Disc. 2003; 2: 52-62.*
Butler, D. First trials of blood-based Ebola therapy kick off. Nature News, 2014; pp. 1-3.*
Liu et al. Heterogeneity of Monoclonal Antibodies. J. Pharmaceut. Sci. 2008; 97(7): 2426-2447.*
Extended European Search Report issued in Application No. 12785929.6 dated Mar. 20, 2015.
Zhou et al., "Structural basis for broad and potent neutralization of HIV-1 by antibody VRC01," Science, American Association for the Advancement of Science, US., Aug. 2010, vol. 329, No. 5993, pp. 811-817.
Adamczyk et al., "Sequencing of anti-thyroxine monoclonal antibody fab fragment by ion trap mass spectrometry," Rapid Commun Mass Spectrom (2000): vol. 14, No. 11, pp. 999-1007 Abstract Only.
Larrick et al., "Rapid cloning of rearranged immunoglobulin genes from human hybridoma cells using mixed primers and the polymerase chain reaction," Biochem Biophys Res Commun (May 15, 1989): vol. 160, No. 3 pp. 1250-1256 Abstract Only.
Scheid et al., "Sequence and structural convergence of broad and potent HIV antibodies that mimic CD4 binding," Scien ePub (Jul. 14, 2011): vol. 333, No. 6049, pp. 1633-1637.
Tiller et al., "Efficient generation of monoclonal antibodies from single human B cells by single cell RT-PCR and expression vector cloning," J. Immunol. Methods (Jan. 1, 2008); 329(1-2):112-124.
Gautam et al., "A single injection of anti-HIV-1 antibodies protects against repeated SHIV challenges," Nature (2016); 000:1-12.
Shingai et al., "Passive transfer of modest titers of potent and broadly neutralizing anti-HIV monoclonal antibodies block SHIV infection in macaques," J. Exp. Med. (2014); 10-2061-2074.

GenBank Accession No. AK130825.1 "*Homo sapiens* cDNA FLJ27315 fis, clone TMS06851, highly similar to Ig epsilon chain C region," [online] <http://www.ncbi.nlm.nih.gov/nucleotide/34527715>, uploaded: Sep. 14, 2006.
GenBank Accession No. AF174028 "*Homo sapiens* clone 77u-c10 immunoglobulin heavy chain variable region precursor (IgH) mRNA, partial cds," [online] <http://www.ncbi.nlm.nih.gov/nuccore/5834015>, uploaded: May 8, 2001.
GenBank Accession No. U43756 "Human immunoglobulin heavy chain variable region mRNA, cell line 28e4, anti-RhD, partial cds," [online] <http://www.ncbi.nlm.nih.gov/nucleodide/1353797>, uploaded: Jun. 5, 1996.
GenBank Accession No. AF062279 "*Homo sapiens* clone Xu-51 immunoglobulin heavy chain variable region (IGH) mRNA, partial cds," [online] <http://www.ncbi.nlm.nih.gov/nuccore/3171030>, uploaded: May 9, 2001.
GenBank Accession No. AF283787 "*Homo sapiens* isolate B-DLCL0018 clone 1 immunoglobulin heavy chain variable region mRNA, partial cds," [online] <http://www.ncbi.nlm.nih.gov/nuccore/12006441>, uploaded: Jan. 2, 2001.
GenBank Accession No. DQ459436 "*Homo sapiens* isolate MM42 immunoglobulin heavy chain variable region gene, partial cds," [online] <http://www.ncbi.nlm.nih.gov/nuccore/92111210>, uploaded: Apr. 22, 2006.
GenBank Accession No. AJ234179 "*Homo sapiens* mRNA for Ig heavy chain variable region, clone C6," [online] <http://www.ncbi.nlm.nih.gov/nucleolide/3821120>, uploaded: Dec. 10, 1999.
GenBank Accession No. AF013625 "*Homo sapiens* immunoglobulin heavy chain variable region (VH4) gene, partial cds," [online] <http://www.ncbi.nlm.nih.gov/nuccore/3135412>, uploaded: May 16, 1998.
GenBank Accession No. BC073765 "*Homo sapiens* immunoglobulin heavy constant alpha 2 (A2mmarker), mRNAchain constant alpha 2 (A2m marker), mRNA (cDNA clone Image:4765168)," [online] <http://www.ncbi.nlm.nih.gov/nudeodide/49258099>, uploaded: Mar. 24, 2009.
GenBank Accession No. HQ650795 "*Homo sapiens* isolate pateitn 5b B-cell receptor immunoglobulin heavy chain variable region (IGVH) gene, partial sequence," [online] <http://www.ncbi.nlm.nih.gov/nuccore/320117094>, uploaded: Apr. 11, 2011.
GenBank Accession No. AY452137 "*Homo sapiens* clone G14F7E5 immunoglobin heavy chain mRNA, partical cds," [online] <http://www.ncbi.nlm.nih.gov/nuccore/42415708>, uploaded: Jul. 16, 2004.
GenBank Accession No. AY996339 "*Homo sapiens* clone MM25 immunoglobin heavy chain variable region mRNA, partical cds," [online] <http://www.ncbi.nlm.nih.gov/nuccore/62911028>, uploaded: May 2, 2005.
Wu et al., "Rational Design of Envelope Identifies Broadly Neutralizing Human Monodonal Antibodies to HIV-1," Science (Aug. 13, 2010); 329:856-861.

* cited by examiner

Figure 1A-B
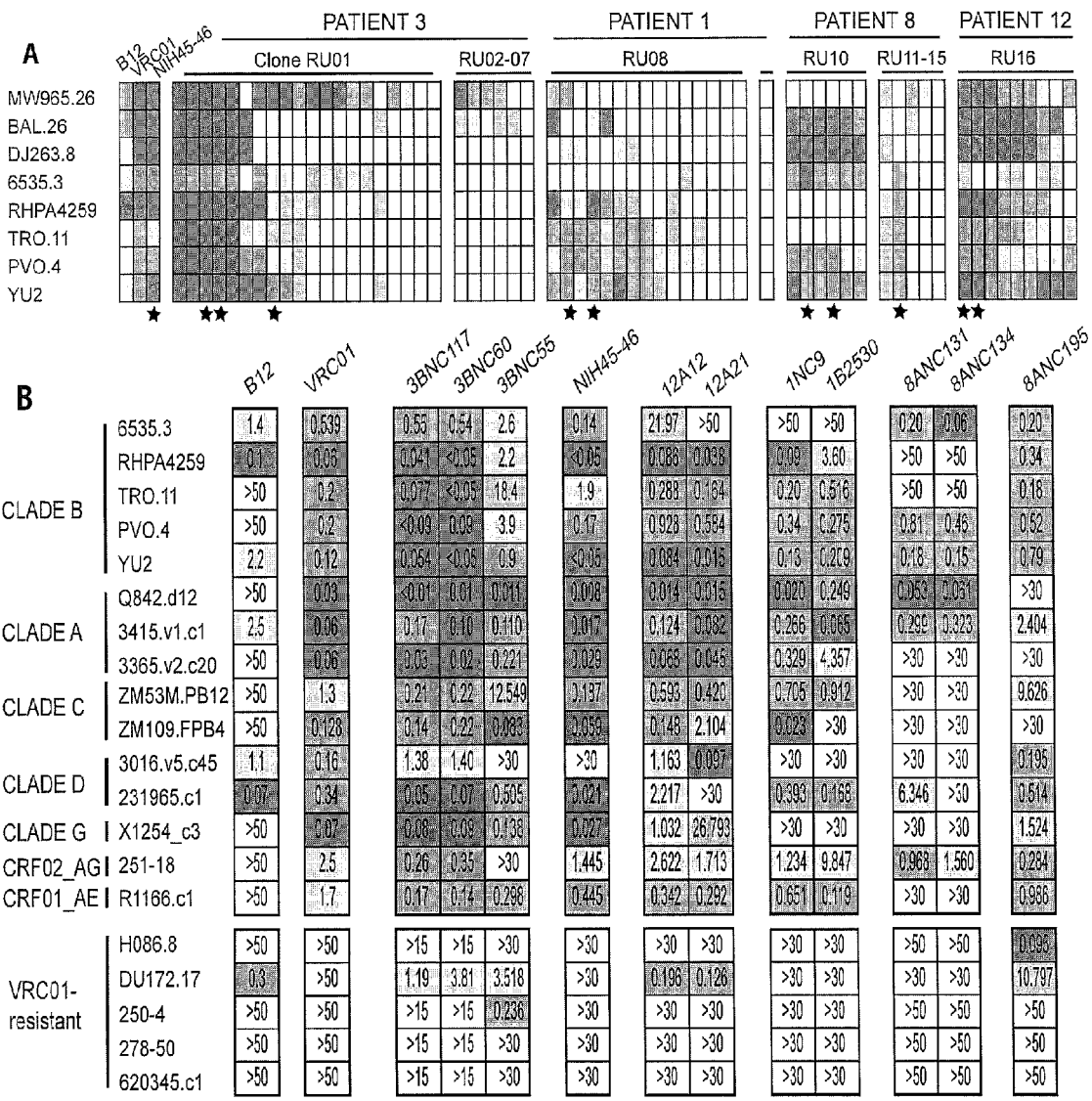

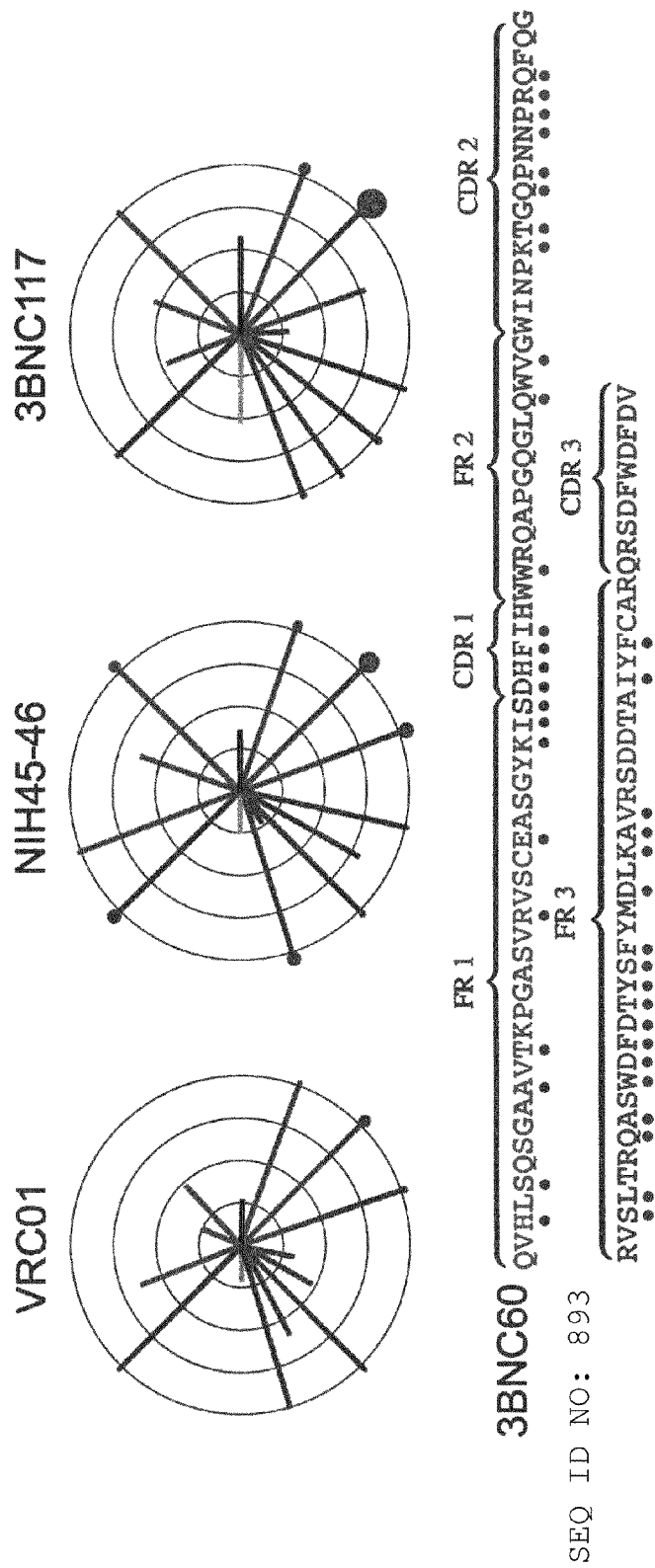
FIGURE 1C-D
SEQ ID NO: 893

FIGURE 3A

| Consensus | SEQ ID NO: 1 |
| --- | --- |
| IgVH1-2 | SEQ ID NO: 890 |
| IgVH1-46 | SEQ ID NO: 891 |
| 3BNC117 | SEQ ID NO: 892 |
| 3BNC60 | SEQ ID NO: 893 |
| 12A12 | SEQ ID NO: 894 |
| 12A21 | SEQ ID NO: 895 |
| NIH45-46 | SEQ ID NO: 896 |
| VRC01 | SEQ ID NO: 897 |
| 8ANC131 | SEQ ID NO: 898 |
| 8ANC134 | SEQ ID NO: 899 |
| 1B2530 | SEQ ID NO: 900 |
| 1NC9 | SEQ ID NO: 901 |
| 8ANC195 | SEQ ID NO: 902 |

FIGURE 3B

| | | |
|---|---|---|
| Consensus | | |
| IgVK3-11 | SEQ ID NO: 2 | 12A21 |
| IgVK1D-33 | SEQ ID NO: 903 | NIH45-46 |
| IgVL1-47 | SEQ ID NO: 904 | VRC01 |
| 3BNC117 | SEQ ID NO: 905 | 8ANC131 |
| 3BNC60 | SEQ ID NO: 906 | 8ANC134 |
| 12A12 | SEQ ID NO: 907 | 1B2530 |
| 12A21 | SEQ ID NO: 908 | 1NC9 |
| NIH45-46 | | |
| VRC01 | | |
| 8ANC131 | | |
| 8ANC134 | | |
| 1B2530 | | |
| 1NC9 | | |
| 8ANC195 | | |

| | |
|---|---|
| Consensus | |
| IgVK3-11 | SEQ ID NO: 909 |
| IgVK1D-33 | SEQ ID NO: 910 |
| IgVL1-47 | SEQ ID NO: 911 |
| 3BNC1117 | SEQ ID NO: 912 |
| 3BNC60 | SEQ ID NO: 913 |
| 12A12 | SEQ ID NO: 914 |
| | SEQ ID NO: 915 |
| | SEQ ID NO: 916 |

OLD PRIMERS

NEW PRIMERS

| 8A | HEAVY VH | J | CDR (aa) | NR OF MISMATCHES | NEW PRIMERS | OLD PRIMERS |
|---|---|---|---|---|---|---|
| 8A2 | 4-61 | 4/5 | Q S L S W Y R P S G Y F E S | 57 | | |
| 8A3 | | 6 | | | | |
| 8A4 | 1-69 | 6 | S I N A A V P G L E G V Y Y Y Y G M A V | 27 | | |
| 8A5 | 1-69 | 6 | | | | |
| 8A6 | 1-69 | 6 | | | | |
| 8A7 | 1-69 | 1/2 | W D Y Y D S R G Y Y Y G E Y F D L | 23 | | |
| 8A8 | 3-21 | 6 | D T K V G A P R Q D C Y A M D L | 29 | | |
| 8A11 | 1-69 | | | 12 | | |
| 8A12 | 3-48 | 6 | L A E V P P A I R G S Y Y Y G M D V | 18 | | |
| 8A13 | 3-11 | 6 | A Y G T G N W R G L Y Y Y Y G M D V | 23 | | |
| 8A14 | 3-30 | 4 | S P S Y Y F D Y | 9 | | |
| 8A21 | 3-30 | 4/5 | E G G L R F L E W L F | 13 | | |
| 8A22 | 3-21 | 6 | S R P P Q R L Y G M D V | 19 | | |
| 8A24 | 3-30 | 4 | D S S G S N W F D Y | 22 | | |
| 8A26 | 3-43 | 5 | N G F D Y | 70 | | |
| 8A30 | 1-69 | 3 | A R A D S H T P I D A F D I | 23 | | |
| 8A33 | 1-69 | 6 | D R W L P Q Y Y Y Y G M D V | 3 | | |
| 8A34 | 3-7 | 2 | N P E S R C I V G R N R G W C R Y F D | 11 | | |
| 8A36 | 3-30 | 4 | P K F L P G A D I V V V A A T P F D | 2 | | |
| 8A39 | 3-43 | 5 | N G F D Y | 70 | | |
| 8A41 | 3-33 | 4/5 | E M A V G G T K A L D H | 10 | | |
| 8A42 | 1-46 | 4/5 | G V S F | 41 | | |
| 8A43 | 3-11 | 4/5 | D L L H A H D F | 13 | | |
| 8A44 | 3-33 | 4 | D S V A F V L E G P I D Y | 23 | | |
| 8A45 | 1-2 | 6 | Y S T R Q F F H Y Y Y V T D V | 26 | | |
| 8A46 | 4-34 | 6 | G K V W G I T A R P R D A G L D | 38 | | |
| 8A47 | 3-7 | 3 | V R D P N Y N L H F D S | 11 | | |
| 8A48 | 3-53 | 4/5 | G L R V Y F D L | 17 | | |
| 8A49 | 1-69 | 3 | | 8 | | |
| 8A50 | 4-39 | 4/5 | Q K G S G T S L L Y | 8 | | |
| 8A51 | 7-4-1 | 4/5 | D L L E S R T Y Y N D I R D C | 7 | | |
| 8A52 | 1-69 | 6 | | 56 | | |
| 8A53 | 4-4 | 4 | V R G S W N F D Y | 15 | | |
| 8A54 | 1-24 | 5 | T Y L A V V P D G F D G Y S S S W Y W F D P | 19 | | |
| 8A55 | 1-69 | 3 | | 8 | | |
| 8A56 | 4-31 | 4/5 | C Q D G L A S R P I D F | 44 | | |
| 8A57 | 3-30 | 4/5 | D S V S K S Y S A P P E F | 39 | | |
| 8A59 | 4-39 | 5 | H V R P Y D R S G Y P F G P N W F D | 37 | | |
| 8A60 | 1-69 | 3 | N A G A Y F Y F F D I | 35 | | |
| 8A61 | 1-46 | 6 | E M G T F T L L G V V I D H Y D F Y P M D V | 24 | | |
| 8A62 | 4-34 | 4 | G R G K R C S G A Y C F A G Y F D S | 37 | | |

FIGURE 4A Cont'd

| CDR3 of | SEQ ID NO: | CDR3 of | SEQ ID NO: |
|---|---|---|---|
| 8A1 | 917 | 8A44 | 960 |
| 8A2 | 918 | 8A45 | 961 |
| 8A3 | 919 | 8A46 | 962 |
| 8A4 | 920 | 8A47 | 963 |
| 8A5 | 921 | 8A48 | 964 |
| 8A6 | 922 | 8A49 | 965 |
| 8A7 | 923 | 8A50 | 966 |
| 8A8 | 924 | 8A51 | 967 |
| 8A9 | 925 | 8A52 | 968 |
| 8A10 | 926 | 8A53 | 969 |
| 8A11 | 927 | 8A54 | 970 |
| 8A12 | 928 | 8A55 | 971 |
| 8A13 | 929 | 8A56 | 972 |
| 8A14 | 930 | 8A57 | 973 |
| 8A15 | 931 | 8A58 | 974 |
| 8A16 | 932 | 8A59 | 975 |
| 8A17 | 933 | 8A60 | 976 |
| 8A18 | 934 | 8A61 | 977 |
| 8A19 | 935 | 8A62 | 978 |
| 8A20 | 936 | 8A63 | 979 |
| 8A21 | 937 | | |
| 8A22 | 938 | | |
| 8A23 | 939 | | |
| 8A24 | 940 | | |
| 8A25 | 941 | | |
| 8A26 | 942 | | |
| 8A27 | 943 | | |
| 8A28 | 944 | | |
| 8A29 | 945 | | |
| 8A30 | 946 | | |
| 8A31 | 947 | | |
| 8A32 | 948 | | |
| 8A33 | 949 | | |
| 8A34 | 950 | | |
| 8A35 | 951 | | |
| 8A36 | 952 | | |
| 8A37 | 953 | | |
| 8A38 | 954 | | |
| 8A39 | 955 | | |
| 8A40 | 956 | | |
| 8A41 | 957 | | |
| 8A42 | 958 | | |
| 8A43 | 959 | | |

B

Pt 8 Clones

FR 1 | CDR 1 | FR 2

```
         ●●
         * *                     *
QVQLVQSGGQMKKPGESMRISCRASGYEFIDCTLNWIRLAPGKRPEWMGWLKPRG    VRC01      SEQ ID NO: 980
QVQLVQSGGQMKKPGESMRISCQASGYEFIDCTLNWVRLAPGRRPEWMGWLKPRG    VRC02      SEQ ID NO: 981
QVRLSQSGGQMKKPGESMRLSCRASGYEFLNCPINWIRLAPGRRPEWMGWLKPRG    NIH45-46   SEQ ID NO: 982
QVRLSQSGGQMKKPGESMRISCRASGYEFIDCTLNWIRLAPGRRPEWMGWLKPRG    NIH45-177  SEQ ID NO: 983
QVRLSQSGGQMKKPGESMRISCRASGYEFIDCTLNWIRLAPGRRPEWMGWLKPRG    NIH45-243  SEQ ID NO: 984
```

CDR 2 | FR 3 | CDR 3

```
  ●●●●*●●*  *   o * ●●                              ●●●
GAVNYARPLQGRVTMTRDVYSDTAFLELRSLTVDDTAVYFCTRGKNCD----YNWDFEHWG    VRC01
GAVNYARPLQGRVTMTRDVYSDTAFLELRSLTADDTAVYYCTRGKNCD----YNWDFEHWG    VRC02
GAVNYARKFQGRVTMTRDVYSDTAFLELRSLTSD TAVYFCTRGKYCTARDYNWDFEHWG    NIH45-46
GAVNYARPLQGRVTMTRDVYSDTAFLELRSLTADDTAVYFCTRGKNCN----YNWDFEHWG    NIH45-177
GAVNYARSFQGRVTMTRDVYSDTAFLELRSLTADDTAVYFCARGKNCD----YNWDFEHWG    NIH45-243
```

B

FR 1 | CDR 1 | FR 2

```
                        *●●
 ●
EIVLTQSPGTLSLSPGETAIISCRTSQYGSLAWYQQRPGQAPRLVIYSGSTRAA    VRC01      SEQ ID NO: 985
EIVLTQSPGTLSLSPGETAIISCRTSQYGSLAWYQQRPGQAPRLVIYSGSTRAA    VRC02      SEQ ID NO: 986
EIVLTQSPATLSLSPGETAIISCRTSQYGSLAWYQQRPGQAPRLVIYSGSTRAA    NIH45-46   SEQ ID NO: 987
EIVLTQSPATLSLSPGETAIISCRTSQYGSLAWYQQRPGQAPRLVIYSGSTRAA    NIH45-177  SEQ ID NO: 988
EIVLTQSPATLSLSPGETAIISCRTSQYGSLAWYQQRPGQAPRLVIYSGSTRAA    NIH45-243  SEQ ID NO: 989
```

FR 3 | CDR 3

```
                          ***
GIPDRFSGSRWGPDYNLTISNLESGDFGVYYCQQYEFFGQ    VRC01
GIPDRFSGSRWGPDYNLIIRNLESGDFGLYYCQQYEFFGQ    VRC02
GIPDRFSGSRWGADYNLSISNLESGDFGVYYCQQYEFFGQ    NIH45-46
GIPDRFSGSRWGPDYNLTISNLESGDFGVYYCQQYEFFGQ    NIH45-177
GIPDRFSGSRWGPDYNLTISNLESGDFGVYYCQQYEFFGQ    NIH45-243
```

| | IC$_{50}$ | Pt 1 | Pt 3B | Pt 8 | NIH45 | Pt 12A |
|---|---|---|---|---|---|---|
| Clade B | 6535.3 | 88 | 400.4 | 25.2 | 61 | 101.3 |
| | RHPA4259.7 | 113 | 16.6 | 154.1 | 36 | 30.1 |
| | SC422661.8 | 49 | 25.9 | 16.6 | 107 | 62.7 |
| | PVO.4 | 88 | 78.1 | 74.1 | 195 | 116.3 |
| | TRO.11 | 72 | 24.5 | 62.2 | 208 | 53.6 |
| | YU2.DG | 131 | 25.4 | 32.7 | 92 | 50.6 |
| | H086.8 | >132 | >132 | >132 | 37 | |
| Clade C | Du172.17 | 228.42 | 418.62 | 65.469 | 349 | |
| | ZM53M.PB12 | 60.70 | 383.37 | >227 | 317 | |
| | ZM109F.PB4 | 86.82 | 12.97 | >227 | 73 | |
| Clade A | Q842.d12 | 12.196 | 6.198 | 4.658 | 50 | |
| | 3415.v1.c1 | 43.26 | 39.58 | 10.03 | 54 | |
| | 3365.v2.c20 | 111.54 | 28.46 | >227 | 94 | |
| CRF02_AG | 250-4 | >132 | 560.58 | 55.09 | 96 | |
| | 251-18 | >340 | 104.58 | 92.28 | 841 | |
| | 278-50 | >132 | >132 | >132 | >1000 | |
| CRF01_AE | 620345.c1 | >132 | >132 | >132 | >1000 | |
| Clade D | 3016.v5.c45 | >340 | 185.62 | >227 | ND | |
| | 231965.c1 | 304.48 | 86.54 | 171.56 | ND | |
| Clade G | X1254_c3 | 222.01 | 61.48 | >227 | ND | |
| CRF01_AE | R1166.c1 | >340 | 52.01 | >227 | ND | |

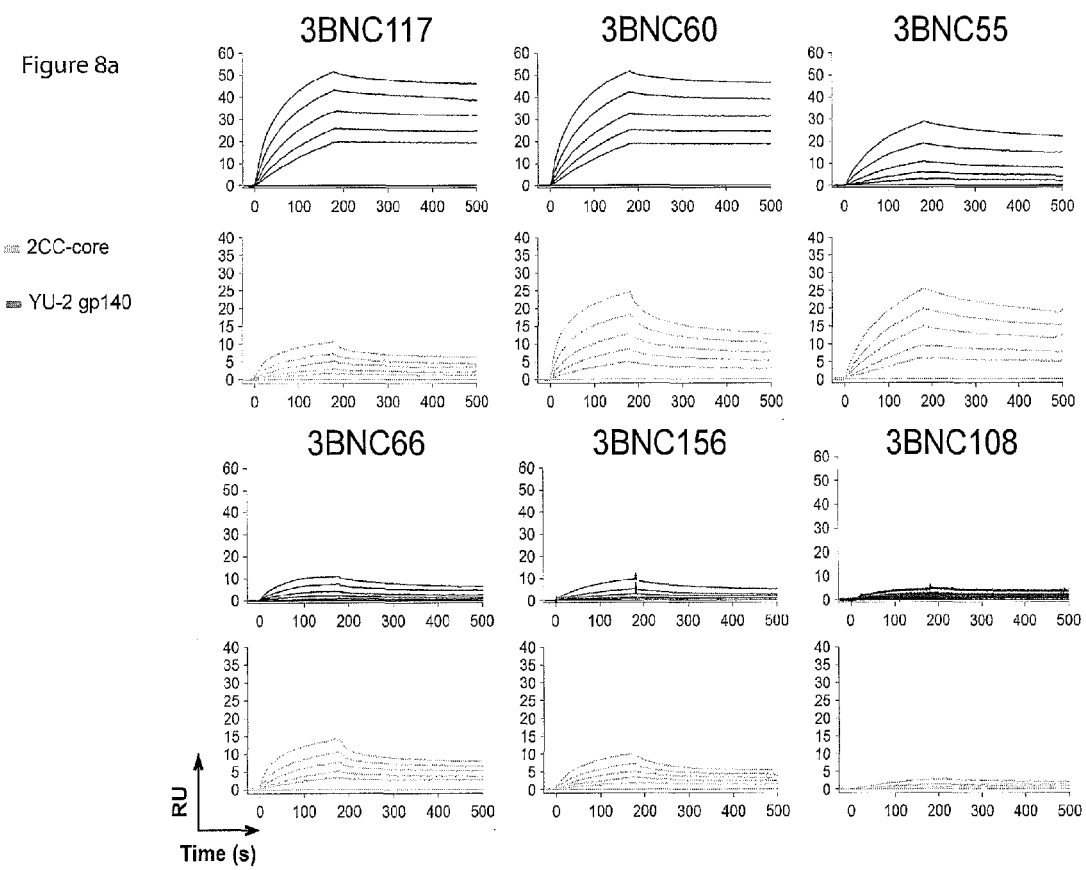

| Protein | SEQ ID NO: |
|---|---|
| 1B2530 | 1020 |
| 1B2586 | 1021 |
| 1B2612 | 1022 |
| 1B2339 | 1023 |
| 1B2680 | 1024 |
| 1NC89 | 1025 |
| 1NC3 | 1026 |
| 1B2364 | 1027 |
| 1NC7 | 1028 |
| 1NC123 | 1029 |
| 1B2503 | 1030 |
| 1B2351 | 1031 |
| 1B344 | 1032 |
| 1B2525 | 1033 |
| 1NC60 | 1034 |
| 1NC82 | 1035 |
| 1B2578 | 1036 |
| 1B2538 | 1037 |
| 1B2609 | 1038 |
| 1B2367 | 1039 |
| 1NC24 | 1040 |
| 1B2573 | 1041 |
| 1NC116 | 1042 |
| 1NC18 | 1043 |
| 1NC66 | 1044 |
| 1NC48 | 1045 |
| 1NC70 | 1046 |
| 1NC52 | 1047 |
| 1NC29 | 1048 |
| 1B2416 | 1049 |
| 1NC108 | 1050 |
| 1NC46 | 1051 |
| 1NC117 | 1052 |
| 1NC9 | 1053 |
| 1NC107 | 1054 |
| 1NC109 | 1055 |
| 1NC56 | 1056 |
| 1NC118 | 1057 |
| 1NC110 | 1058 |
| 1NC33 | 1059 |
| 1NC122 | 1060 |
| 1NC95 | 1061 |

FIGURE 10B Cont'd

| Protein | SEQ ID NO: | Protein | SEQ ID NO: |
|---|---|---|---|
| 3BNC75 | 1062 | 3BNC104 | 1105 |
| 3B16 | 1063 | 3BNC106 | 1106 |
| 3BNC95 | 1064 | 3BNC44 | 1107 |
| 3BNC176 | 1065 | 3BNC127 | 1108 |
| 3B188 | 1066 | 3BNC6 | 1109 |
| 3B180 | 1067 | 3BNC148 | 1110 |
| 3BNC65 | 1068 | 3BNC173 | 1111 |
| 3BNC79* | 1069 | 3BNC181 | 1112 |
| 3BNC105 | 1070 | 3BNC101 | 1113 |
| 3B183 | 1071 | | |
| 3B21 | 1072 | | |
| 3B191 | 1073 | | |
| 3BNC128 | 1074 | | |
| 3BNC23 | 1075 | | |
| 3BNC196 | 1076 | | |
| 3BNC91* | 1077 | | |
| 3BNC134 | 1078 | | |
| 3BNC81 | 1079 | | |
| 3BNC84 | 1080 | | |
| 3BNC107 | 1081 | | |
| 3BNC42 | 1082 | | |
| 3BNC142* | 1083 | | |
| 3BNC53* | 1084 | | |
| 3BNC123 | 1085 | | |
| 3BNC153 | 1086 | | |
| 3BNC156* | 1087 | | |
| 3BNC72 | 1088 | | |
| 3BNC158 | 1089 | | |
| 3BNC66 | 1090 | | |
| 3BNC159 | 1091 | | |
| 3BNC151 | 1092 | | |
| 3BNC108* | 1093 | | |
| 3BNC55 | 1094 | | |
| 3BNC89 | 1095 | | |
| 3ANC41 | 1096 | | |
| 3ANC87 | 1097 | | |
| 3ANC66* | 1098 | | |
| 3ANC79 | 1099 | | |
| 3BNC126 | 1100 | | |
| 3BNC149 | 1101 | | |
| 3BNC102 | 1102 | | |
| 3ANC3 | 1103 | | |
| 3ANC32 | 1104 | | |

FIGURE 10C Cont'd

| Protein | SEQ ID NO: |
|---|---|
| 8ABM1 | 1114 |
| 8ABM24 | 1115 |
| 8ABM11 | 1116 |
| 8A253 | 1117 |
| 8ANC131 | 1118 |
| 8ANC13 | 1119 |
| 8ANC88 | 1120 |
| 8ANC134 | 1121 |
| 8ANC26 | 1122 |
| 8ANC127 | 1123 |
| 8ANC40 | 1124 |
| 8ABM13 | 1125 |
| 8ANC22 | 1126 |
| 8ABM12 | 1127 |
| 8A275 | 1128 |
| 8ANC116 | 1129 |
| 8ANC53 | 1130 |
| 8ANC2 | 1131 |
| 8ANC30 | 1132 |
| 8ABM26 | 1133 |
| 8ABM20 | 1134 |
| 8ANC18 | 1135 |
| 8ANC182 | 1136 |
| 8ANC41 | 1137 |
| 8ABM27 | 1138 |

HUMAN IMMUNODEFICIENCY VIRUS NEUTRALIZING ANTIBODIES AND METHODS OF USE THEREOF

CROSS-REFERENCE TO RELATED APPLICATIONS

This application is a U.S. National Phase of International Application No. PCT/US2012/038400, filed May 17, 2012, which claims priority under 35 U.S.C. §119(e) to U.S. Provisional Application No. 61/486,960 filed on May 17, 2011. The disclosures of which are hereby incorporated in their entirety.

STATEMENT REGARDING FEDERALLY FUNDED RESEARCH

The research leading to the present invention was supported in part, by National Institutes of Health Grant No. P01 AI08677-01. Accordingly, the U.S. Government has certain rights in this invention.

FIELD OF THE INVENTION

The present invention relates to antibodies directed to epitopes of Human Immunodeficiency Virus ("HIV"). The present invention further relates to the preparation and use of broadly neutralizing antibodies directed to the HIV gp120 envelope protein for the prevention and treatment of HIV infection.

BACKGROUND OF THE INVENTION

HIV causes Acquired Immunodeficiency Syndrome ("AIDS"). The immune response to HIV infection in long-term non-progressors suggests that specific viral immunity may limit infection and the symptoms of disease. Some HIV infected individuals show broadly neutralizing IgG antibodies in their serum; little is known regarding the specificity and activity of these antibodies, despite their potential importance in designing effective vaccines, and no single characteristic has of yet been correlated with protective immunity. In animal models, passive transfer of neutralizing antibodies can contribute to protection against virus challenge. Neutralizing antibody responses also can be developed in HIV-infected individuals but the detailed composition of the serologic response is yet to be fully uncovered.

A number of immunologic abnormalities have been described in AIDS. These include, but are not limited to, abnormalities in B-cell function, abnormal antibody response, defective monocyte cell function, impaired cytokine production, depressed natural killer and cytotoxic cell function, defective ability of lymphocytes to recognize and respond to soluble antigens, and the depletion of the T4 helper/inducer lymphocyte population.

The amino acid and RNA sequences encoding HIV env from a number of HIV strains are known (Modrow, S. et al., J. Virology 61(2): 570 (1987)). The HIV virion is covered by a membrane or envelope derived from the outer membrane of host cells. This membrane contains a population of envelope glycoproteins (gp 160) anchored in the membrane bilayer at their carboxyl terminal region. Each glycoprotein contains two segments: the N-terminal segment, and the C-terminal segment. The N-terminal segment, called gp120 by virtue of its relative molecular weight of about 120 kD, protrudes into the aqueous environment surrounding the virion. The C-terminal segment, called gp41, spans the membrane. The N-terminal gp120 and the C-terminal gp41 are covalently linked by a peptide bond that is particularly susceptible to proteolytic cleavage. See European Patent Application Publication No. 0 335 635 to McCune et al and the references cited therein, each incorporated herein by reference in its entirety.

Several approaches to an AIDS vaccine have been proposed, including, but not limited to, inactivated and attenuated virus vaccines, subunit vaccines from virus-infected cells, recombinantly produced viral antigens, vaccines based on synthetic peptides, anti-idiotypic vaccines, and viral carrier-based vaccines. An additional approach to HIV therapeutic and prophylactic treatment includes making highly potent, broadly neutralizing monoclonal antibodies. Multiple studies have reported cloning and making monoclonal antibodies by various techniques for targeting the CD4 binding site as well as other parts of the virion spike and for neutralizing HIV. Generally, these techniques involve self-fusion or phage display techniques. Typically, in making HIV neutralizing antibodies using phage display techniques, random combinations of heavy and light chains are combined and a random pair is selected. Studies have reported a limited number of monoclonal antibodies, such as, for example, the phage display antibody b12, that are broadly highly potent, and broadly neutralizing (meaning antibodies that can neutralize multiple strains of HIV in sera) against HIV. The monoclonal antibody b12 is a broadly neutralizing antibody which has been reported to prevent HIV infection in macaques. Another broadly neutralizing antibody includes 2G12, which, atypically, has a structure which has yet to be seen in any other antibody with three combining sites. VRC01 is recently discovered broadly neutralizing antibody that targets the CD4 binding site (CD4bs) on the HIV spike. VRC01 was isolated by purifying single B cells that bind to a soluble, biotin labeled, stabilized, and re-surfaced core fragment of HIV gp120 (X. Wu et al., Science 329, 856 (Aug. 13, 2010)). Although successful, the isolation was inefficient, producing only 3 closely related HIV-binding antibodies from 25 million peripheral blood mononuclear cells from one individual. Like other anti-HIV antibodies obtained by the single cell antigen capture method, VRC01-3 showed very high levels of somatic mutations that were essential for potency and breadth. This high frequency of mutation is a potential impediment to antibody cloning because the mutated sequences may no longer be complementary to the primers used for cloning.

Some studies have reported that certain patients develop antibodies to HIV that are broadly neutralizing. Studies have reported that antibodies can be protective against initial HIV infection in passive transfer experiments in non-human primates and can modulate viral load during infection. See, for example, Mascola, 2000; Shibata, 1999; Veazey, 2003; Parren, 2001; Mascola, 1999; Trkola, 2005; Wei, 2003; Frost, 2005; Burton, 2004; Mascola, 2007; Karlsson Hedestam, 2008; McMichael, 2006; Zolla-Pazner, 2004.

BRIEF SUMMARY OF THE INVENTION

The present invention, in one embodiment, provides broadly neutralizing antibodies against HIV. In one embodiment, the present invention provides an isolated HIV antibody comprising a heavy chain comprising the consensus amino acid sequence: QXXLXQSGGXVKKPGXS-VXVSCXASGYXXFXXYXIHWXRQAPGXGXX-WVGXI XPRXGXXXXAXXFQGRLSLTRDXXXXXX-TXXXFMDLXGLRXDDTAVYFCARX XXXXXXXXXXXXXXXXXXDX (SEQ ID NO:1) wherein X indicates any amino acid or no amino acid.

In another embodiment, the present invention provides an isolated HIV antibody comprising the consensus amino acid sequence: EIXLTQSPXSLSXSXGEXXTISCXXX-QXXXXXXXLXWYQQRXGXAPRLLIXXXSX XXXGVPXRFSGXXXGXXYXLXISXLXXDDXAXY-FCXXYEXXXXXXX (SEQ ID NO: 2) wherein X indicates any amino acid or no amino acid.

In another embodiment, the present invention provides an isolated HIV antibody comprising a heavy chain comprising a highly conserved consensus sequence and a light chain comprising a highly conserved consensus sequence. The present invention further provides a method of producing an isolated HIV antibody comprising a heavy chain comprising a highly conserved consensus sequence and a light chain comprising a highly conserved consensus sequence.

In another embodiment, the present invention provides an isolated HIV antibody comprising the heavy chain consensus sequence of SEQ ID NO:1 and the light chain sequence of SEQ ID NO:2. In a further embodiment, the present invention provides an isolated HIV antibody comprising one or both of the heavy chain consensus sequence of SEQ ID NO:1 and the light chain sequence of SEQ ID NO:2, or sequences having at least 70%, or at least 80%, or at least 85%, or at least 90%, or at least 95%, or at least 97%, or at least 98%, or at least 99% identity thereto, with the proviso that the antibody does not have the amino acid sequence of VRC01.

In another embodiment, the present invention provides an isolated HIV antibody comprising one or both of the heavy chain consensus sequence of SEQ ID NO:1 and the light chain consensus sequence of SEQ ID NO:2 and wherein the antibody neutralizes HIV virus ZM53M.PB12 at an $IC_{50}$ concentration of less than 1.0 µg/ml, or HIV virus R1166.c1 at an $IC_{50}$ concentration of less than 1.0 µg/ml, or DU172.17 at an $IC_{50}$ concentration of less than 30 µg/ml. In another embodiment, the present invention provides an isolated HIV antibody comprising one or both of the heavy chain consensus sequence of SEQ ID NO:1 and the light chain consensus sequence of SEQ ID NO:2, wherein the antibody neutralizes a VRC01-resistant HIV virus at an $IC_{50}$ concentration of less than 30 µg/ml.

In another embodiment, the present invention provides an isolated HIV antibody selected from the group consisting of 3BNC117, 3BNC60, 12A12, 12A21, NIH45-46, 8ANC131, 8ANC134, IB2530, INC9 and 8ANC196.

In another embodiment, the present invention provides an isolated HIV antibody comprising heavy chain CDR1, CDR2 and CDR3 regions and light chain CDR1, CDR2 and CDR3 regions comprising the amino acid sequences of the corresponding regions of an HIV antibody selected from the group consisting of 3BNC117, 3BNC60, 12A12, 12A21, NIH45-46, bANC131, 8ANC134, IB2530, INC9 and 8ANC196.

In another embodiment, the present invention provides an isolated HIV antibody comprising a heavy chain comprising an amino acid sequence selected from the group consisting of SEQ ID NOs: 5-438.

In another embodiment, the present invention provides an isolated HIV antibody comprising a light chain comprising an amino acid sequence selected from the group consisting of SEQ ID NOs: 439-583.

In another embodiment, the present invention provides an isolated HIV antibody comprising a heavy chain and a light chain comprising an amino acid sequence set forth in Table A or Table B.

In another embodiment, the present invention provides an isolated HIV antibody comprising an insertion sequence comprising the amino acid sequence: ASWDFDF (SEQ ID NO:3).

In another embodiment, the present invention provides an isolated HIV antibody comprising an insertion sequence comprising the amino acid sequence: TARDY (SEQ ID NO:4).

In another embodiment, the present invention provides an isolated HIV antibody comprising insertion sequences SEQ ID No: 3 and SEQ ID No: 4.

In another embodiment, the present invention provides a method to improve the HIV neutralization potency and breadth of an isolated HIV antibody comprising inserting at least one of insertion sequences SEQ ID No: 3 and SEQ ID No: 4.

According to another embodiment, the present invention provides compositions comprising an isolated HIV antibody of the invention.

According to another embodiment, the present invention provides pharmaceutical compositions comprising an antibody of the invention and a pharmaceutically acceptable carrier.

According to another embodiment, the present invention provides nucleic acid molecules encoding an isolated HIV antibody of the invention.

According to other embodiments, the present invention provides vectors comprising nucleic acid molecules encoding an isolated HIV antibody of the invention, and cells comprising such vectors.

According to another embodiment, the present invention provides a method of preventing or treating HIV infection or an HIV-related disease comprising the steps of: identifying a mammalian subject in need of such prevention or treatment, and administering to said subject a therapeutically effective amount of at least one HIV antibody of the invention.

According to another embodiment, the method further comprises the administration of a second therapeutic agent. According to another embodiment, the second therapeutic agent is an antiviral agent.

Another embodiment of the present invention provides a method of reducing virus replication or spread of infection to additional host cells or tissues comprising contacting a mammalian cell with at least one antibody of the invention. According to another aspect, the present invention provides for a method for treating a mammalian subject infected with HIV, the method comprising administering to said subject a pharmaceutical composition comprising at least one antibody according to the invention.

According to another embodiment, the present invention provides a method for the preparation and administration of an HIV antibody preparation which is suitable for administration to a mammalian subject having or at risk of HIV infection, in an amount and according to a schedule sufficient to induce a protective immune response against HIV or reduction of the HIV virus in a mammalian subject. In another embodiment, the present invention provides a method for detecting an HIV antibody comprising a heavy chain comprising a highly conserved consensus sequence and a light chain comprising a highly conserved consensus sequence in a biological sample.

In another embodiment, the present invention provides the isolated antibodies of the invention for use in the treatment of HIV.

In another embodiment, the present invention provides a kit comprising a pharmaceutically acceptable dose unit of a pharmaceutically effective amount of at isolated HIV antibody of the invention, and a pharmaceutically acceptable dose unit of a pharmaceutically effective amount of an HIV agent selected from the group consisting of a non-nucleoside reverse transcriptase inhibitor, a protease inhibitor, a entry or fusion inhibitor and an integrase inhibitors, wherein the two pharmaceutically acceptable dose units can optionally take the form of a single pharmaceutically acceptable dose unit.

In another embodiment, the present invention provides a kit for the diagnosis, prognosis or monitoring the treatment of HIV in a subject comprising one or more detection reagents which specifically bind to anti-HIV neutralizing antibodies in a biological sample from a subject. In another aspect of the invention, the kit further provides reagents for performing PCR or mass spectrometry.

BRIEF DESCRIPTION OF THE DRAWINGS

FIGS. 1A-D show the HIV antibody neutralizing activity $IC_{50}$. (A) Limited panel. Top line indicates the donor number, then clone or antibody (Table 4); viruses are shown on the left. Colors indicate concentration at $IC_{50}$: red ≤0.1µg/ml; orange 0.1-1 µg/ml; yellow 1-10 µg/ml; green ≥10µg/ml; white not neutralized at any concentration tested. (B) Extended panel. (C) Neutralization summary graph comparing VRC01, NIH45-46, 3BNC117.Length of lines and size of circles inversely proportional to $IC_{50}$. Colors indicate viral clades: red A; blue B; green C; fucia D; black AE; gold AG. (D) Sequence of 3BNC60 (SEQ ID NO: 893), 1B2530 and 8ANC134 heavy chains with coverage by peptides found by Mass Spec in light grey. Red dots indicate differences from respective germline sequences.

FIGS. 3A and B show the HIV antibody consensus sequence, and HIV antibody amino acid sequences. (A) Amino acid alignment relative to framework (FR) and CDR regions for consensus, germline genes, 10 selected antibodies and 8ANC195 (SEQ ID NOS 1 and 890-902, respectively, in order of appearance). Residues are numbered according to the 3BNC60 structure. (B) As in (A) for light chains (SEQ ID NOS 2 and 903-916, respectively, in order of appearance). (C, D, and E) Crystal structure of 3BNC60 Fab.

FIG. 4A discloses SEQ ID NOS 917-979,respectively, in order of appearance. (B) HIV antibodies that bind to 2CC-core from Pt 8.Clonal families are shown by differently expanded slices. Two highly mutated clones that were not amplified with the old primer set are shown in striped pie slices.

FIG. 5 shows Ig V heavy (A) (SEQ ID NOS 980-984, respectively, in order of appearance) and light chain (B) (SEQ ID NOS 985-989, respectively, in order of appearance) sequences of new VRC01 clonal members.

Figure 9A:
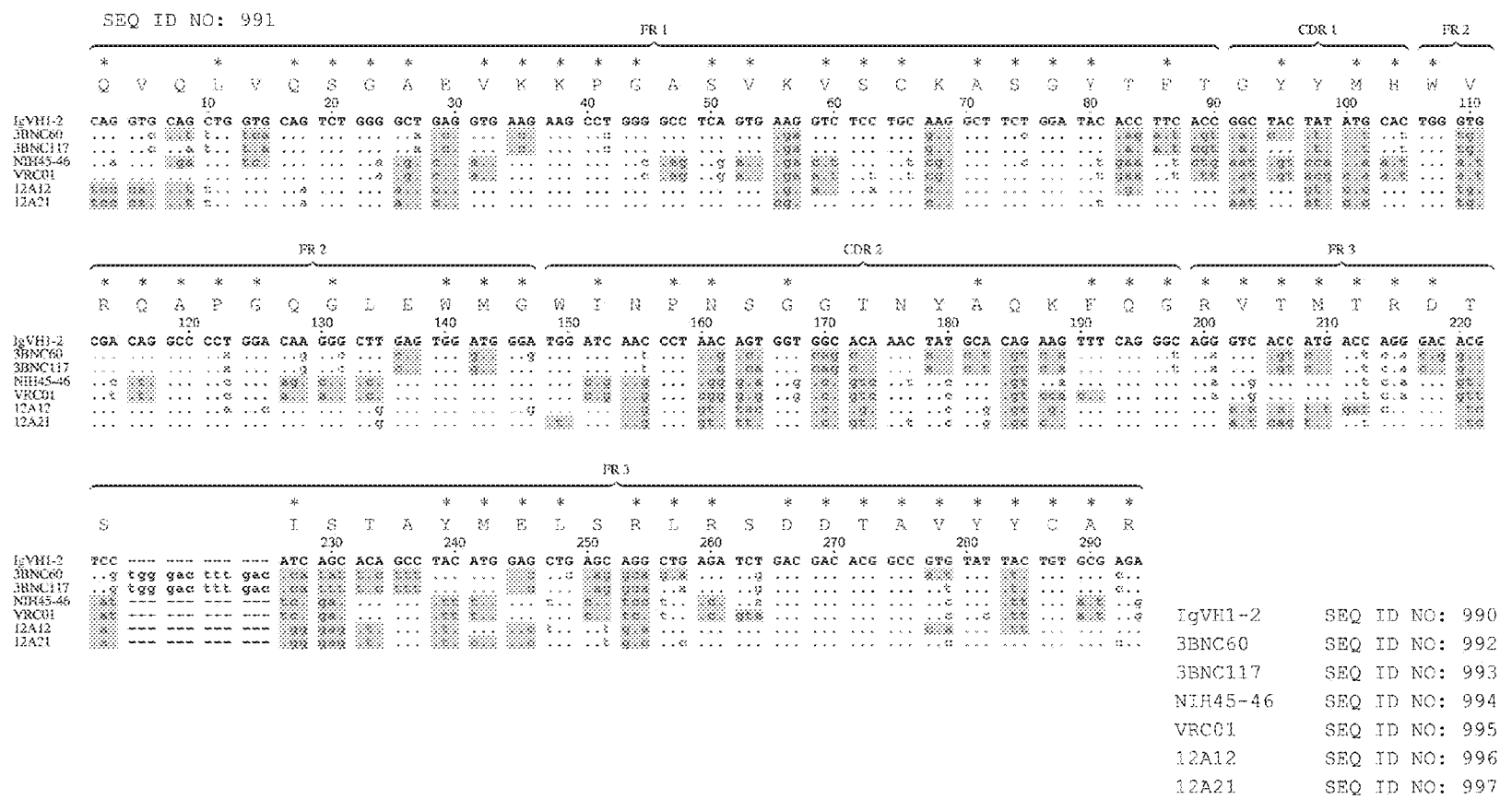
Figure 9A:
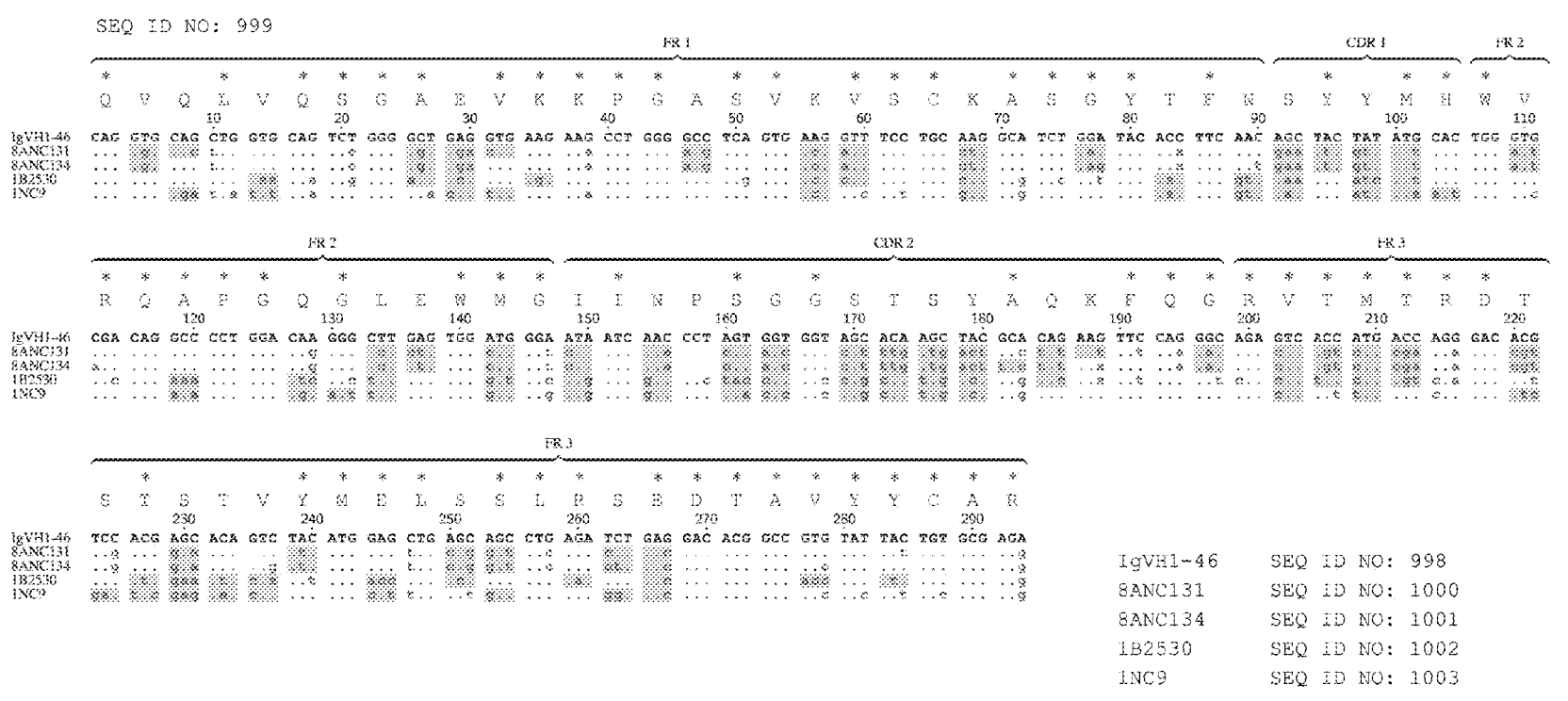
Figure 9B:
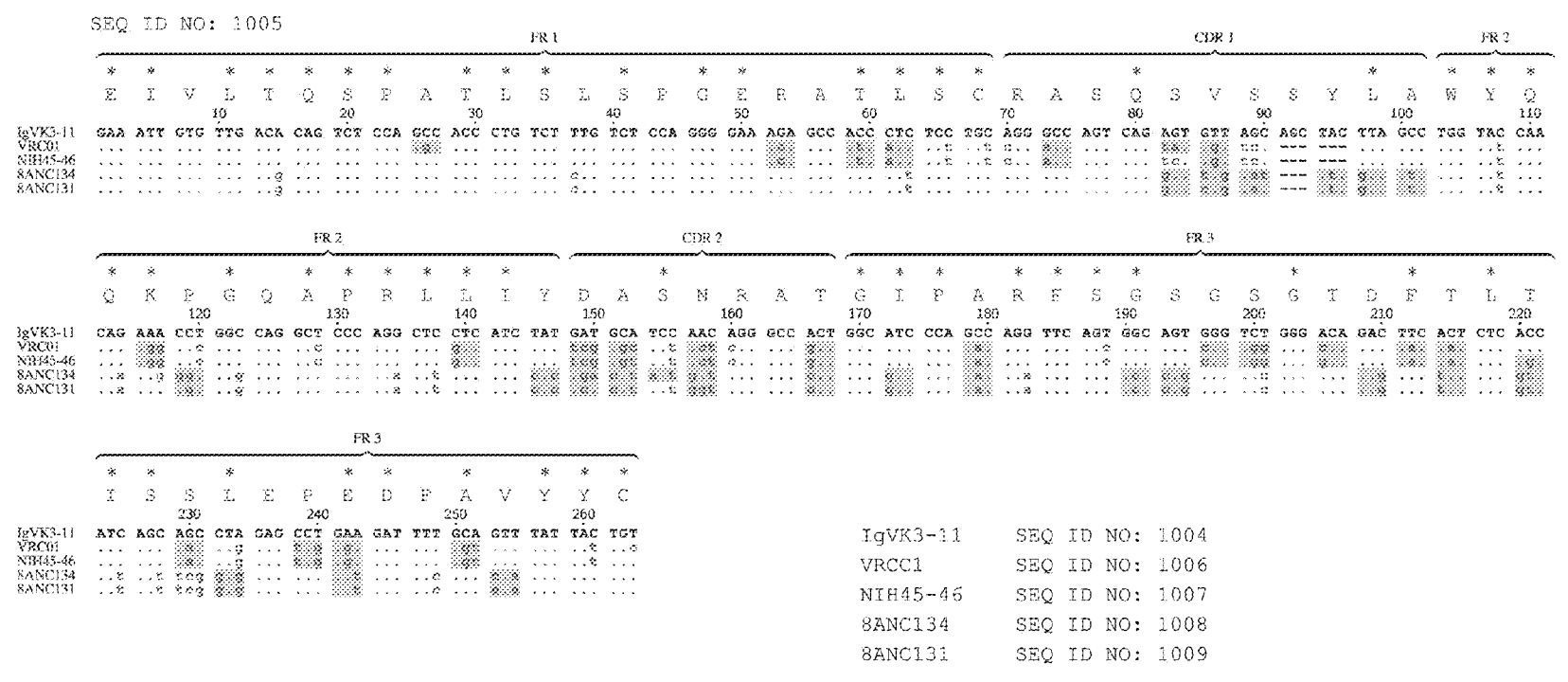
Figure 9B:
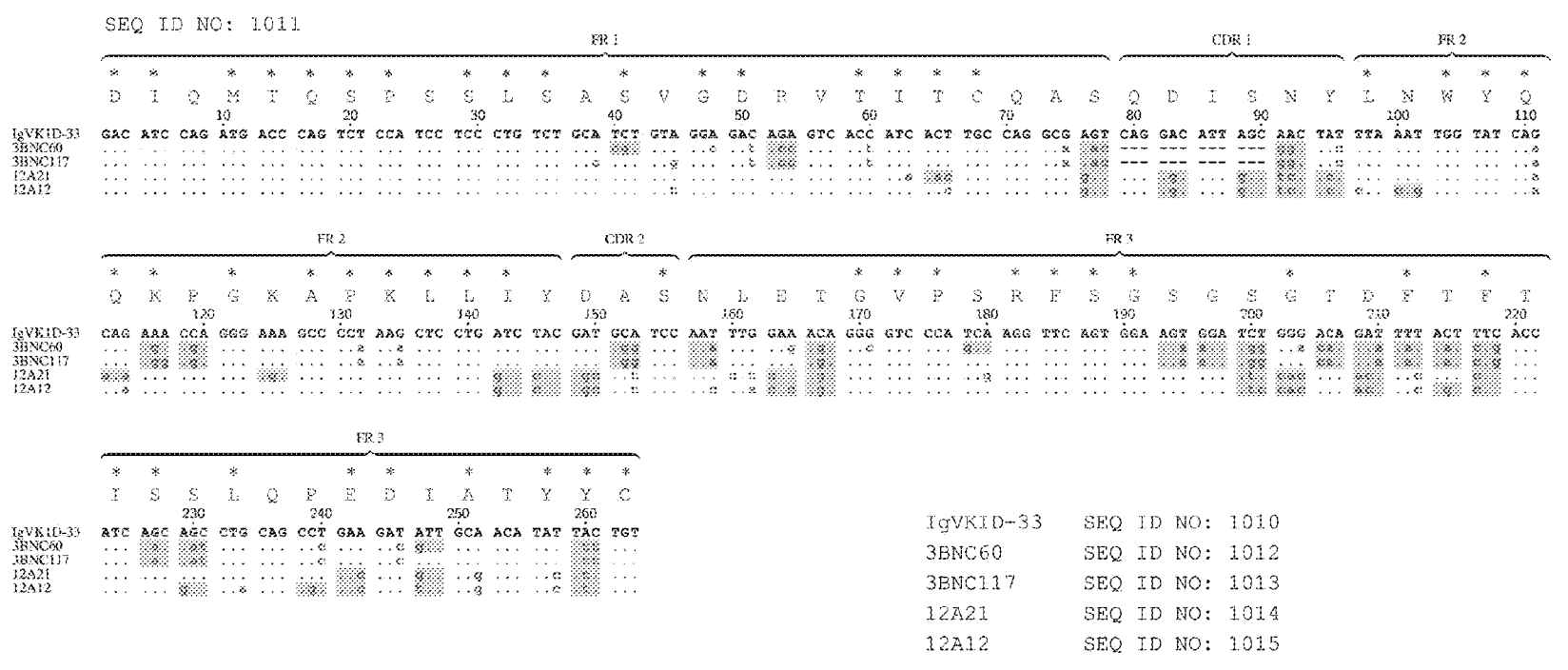
Figure 9C:
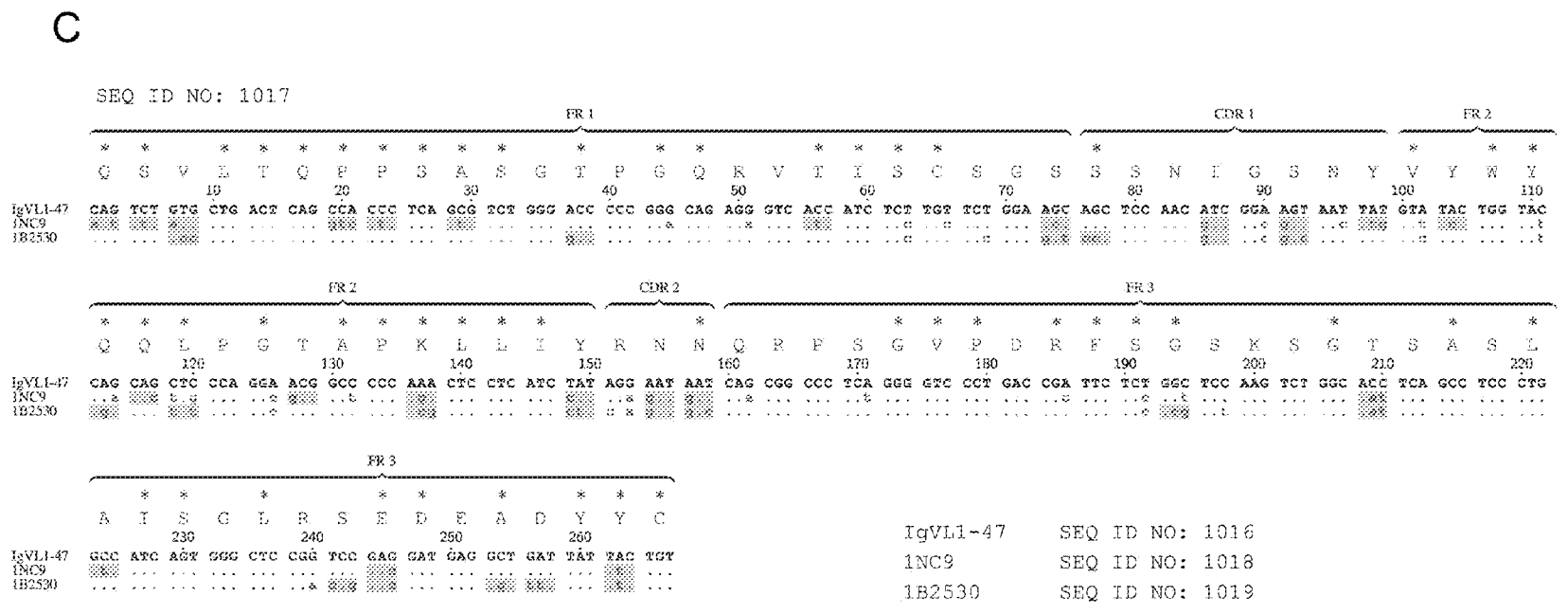

FIGS. 9A-C illustrate the somatic hypermutation analysis of selected HIV antibodies for (A) immunoglobulin heavy chain gene, (B) light chain kappa and (C) light chain lambda gene sequences. Sequences are aligned with their respective germline nucleotide sequences. Somatic mutations are shown in red letters, additionally gray boxes designate replacement mutations. Germline amino acid sequences with * indicating consensus residues are shown above the nucleotide alignment. FIG. 9A discloses SEQ ID NOS 991, 990, and 992-997;FIG. 9A Cont'd discloses SEQ ID NOS 999, 998, and 1000-1003; FIG. 9B discloses SEQ ID NOS 1005, 1004, and 1006-1009; FIG. 9B Cont'd discloses SEQ ID NOS 1011, 1010, and 1012-1015;and FIG. 9C discloses SEQ ID NOS 1017, 1016, and 1018-1019, all respectively, in order of appearance.

FIGS. 10 A-C shows antibody sequences from one expanded neutralizing clone in each (A) Patient (Pt)1, (B) Pt3 and (C) Pt8. Peptides identified by mass spectrometry are indicated in color. The variants marked with an asterisk are uniquely defined by one or more mass spectrometrically observed peptides (shown in light grey). The remaining mass spectrometrically observed peptides map non-uniquely to multiple variants as shown in dark grey. Underlined amino acids indicate non-tryptic cleavage sites in the variants shown. The cleavages are presumed to occur through chymotryptic cleavage or additional mutations (not observed among the cloned variants) that place a lysine or arginine residue at these sites.

DETAILED DESCRIPTION OF THE INVENTION

I. HIV Neutralizing Antibodies

Figure 2:
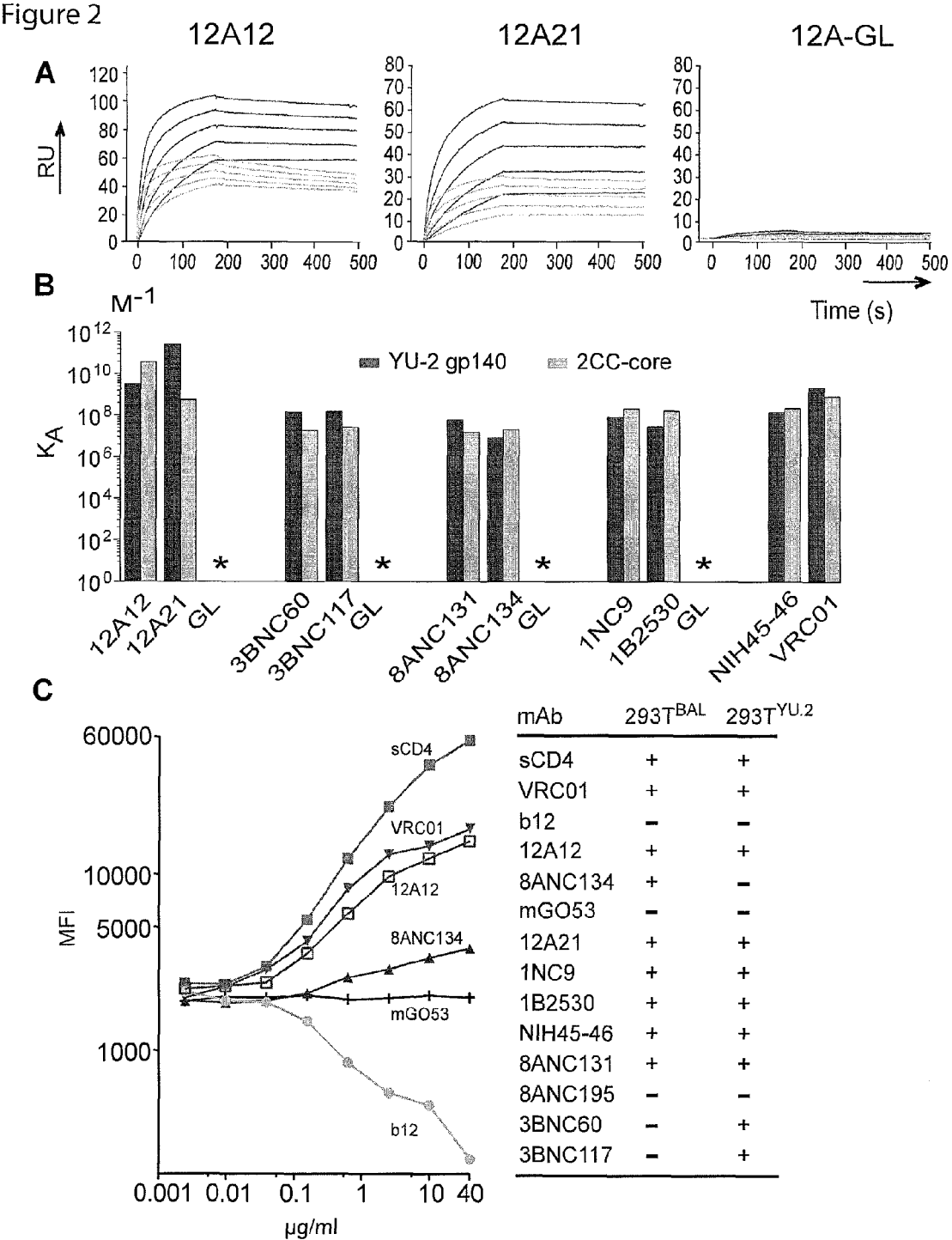
FIGS. 2A-C show the binding properties of the HIV antibodies. (A) Represenstive SPR sensograms for binding to YU2-gp140 and 2CC-core by 12A12, 12A21 and 12A-germline (GL) reverted antibodies. (B) Graph shows $K_A$ for representative antibodies. (C) Graph shows mean fluorescence intensity of anti-CD4i antibody binding to Bal.26 expressing 293T cells after incubation with the indicated antibodies. Table indicates whether or not an antibody induces CD4i site accessibility.

The present invention, in one embodiment, provides broadly neutralizing antibodies against HIV. In one embodiment, the present invention provides an isolated HIV antibody comprising a heavy chain comprising the consensus amino acid sequence: QXXLXQSGGXVKKPGXS-VXVSCXASGYXXFXXYXIHWXRQAPGXGXX- WVGXI XPRXGXXXXAXXFQGRLSLTRDXXXXXX-TXXXFMDLXGLRXDDTAVYFCARX XXXXXXXXXXXXXXXXXXDX (SEQ ID NO:1) wherein X indicates any amino acid or no amino acid.

In another embodiment, the present invention provides an isolated HIV antibody comprising a light chain comprising the consensus amino sequence: EIXLTQSPXSLSX-SXGEXXTISCXXXQXXXXXXXLXWYQQRXGX-APRLLIXXXSX XXXGVPXRFSGXXXGXXYXLXISX-LXXDDXAXYFCXXYEXXXXXXX (SEQ ID NO:2) wherein X indicates any amino acid or no amino acid.

In another embodiment, the present invention provides an isolated HIV antibody comprising the heavy chain sequence of SEQ ID NO:1 and the light chain sequence of SEQ ID NO:2. In a further embodiment, the present invention provides an isolated HIV antibody comprising one or both of the heavy chain sequence of SEQ ID NO:1 and the light chain sequence of SEQ ID NO:2, or sequences having at least 70%, or at least 80%, or at least 85%, or at least 90%, or at least 95%, or at least 97%, or at least 98%, or at least 99% identity thereto, with the proviso that the antibody does not have the amino acid sequence of VRC01. Percentage identity is determined as disclosed hereinbelow.

The present invention provides, in other embodiments, an isolated HIV antibody comprising a heavy chain comprising an highly conserved heavy chain amino acid sequence and a light chain comprising a highly conserved light chain amino acid sequence. A highly conserved heavy chain amino acid sequence is defined herein as an amino acid sequence having at least 70%, or at least 80%, or at least 85%, or at least 90%, or at least 95%, or at least 97%, or at least 98%, or at least 99% identity with the sequence of SEQ ID NO:1. A highly conserved light chain amino acid sequence is defined herein as an amino acid sequence having at least 70%, or at least 80%, or at least 85%, or at least 90%, or at least 95%, or at least 97%, or at least 98%, or at least 99% identity with the sequence of SEQ ID NO:2. Percentage identity is determined as disclosed hereinbelow.

In another embodiment, present invention provides an isolated HIV antibody comprising a heavy chain comprising an highly conserved heavy chain amino acid sequence and a light chain comprising a highly conserved light chain amino acid sequence, with the proviso that the antibody does not have the sequence of VRC01.

In another embodiment, the present invention provides an isolated HIV antibody comprising one or both of the heavy chain sequence of SEQ ID NO:1 and the light chain sequence of SEQ ID NO:2 and wherein the antibody neutralizes HIV virus ZM53M.PB12 at an $IC_{50}$ concentration of less than 1.0 μg/ml, or HIV virus R1166.c1 at an $IC_{50}$ concentration of less than 1.0 μg/ml, or DU172.17 at an $IC_{50}$ concentration of less than 30 μg/ml. In another embodiment, the present invention provides an isolated HIV antibody comprising one or both of the heavy chain sequence of SEQ ID NO:1 and the light chain sequence of SEQ ID NO:2, wherein the antibody neutralizes a VRC01-resistant HIV virus at an $IC_{50}$ concentration of less than 30 μg/ml. A VRC01-resistant HIV virus is defined herein as an HIV virus that is resistant to neutralization by VRC01 at an $IC_{50}$ value of 50 μg/ml. VRC01-resistant HIV viruses include, for example, HO86.8, DU172.17, 250-4, 278-50, and 620345.c1.

In another embodiment, the present invention provides an isolated HIV antibody selected from the group consisting of 3BNC117, 3BNC60, 12A12, 12A21, NIH45-46, bANC131, 8ANC134, IB2530, INC9 and 8ANC196.

In another embodiment, the present invention provides an isolated HIV antibody comprising heavy chain CDR1, CDR2 and CDR3 regions and light chain CDR1, CDR2 and CDR3 regions comprising the amino acids sequences of the corresponding regions of an HIV antibody selected from the group consisting of 3BNC117, 3BNC60, 12A12, 12A21, NIH45-46, bANC131, 8ANC134, IB2530, INC9 and 8ANC196.

In another embodiment, the present invention provides an isolated HIV antibody comprising a heavy chain comprising an amino acid sequence selected from the group consisting of SEQ ID NOs: 5-438.

In another embodiment, the present invention provides an isolated HIV antibody comprising a light chain comprising an amino acid sequence selected from the group consisting of SEQ ID NOs: 439-583.

In another embodiment, the present invention provides an isolated HIV antibody comprising a heavy chain and a light chain comprising an amino acid sequence set forth in Table A or Table B.

In another embodiment, the present invention provides an isolated HIV antibody comprising an insertion sequence comprising the amino acid sequence: ASWDFDF (SEQ ID NO:3). In a further embodiment, the present invention provides an isolated HIV antibody wherein insertion sequence SEQ ID No: 3, which corresponds to the FR3 region of the heavy chain commencing at amino acid 74 of 3BNC117 and 3BNC60 as shown in FIG. 5A, is substituted for the corresponding region, as determined by sequence alignment, of an HIV antibody of the invention. For example, SEQ ID No: 3 may be inserted after the seventh amino acid of FR3 of the heavy chain.

In another embodiment, the present invention provides an isolated HIV antibody comprising an insertion sequence comprising the amino acid sequence: TARDY (SEQ ID NO:4). In a further embodiment, the present invention provides an isolated HIV antibody wherein insertion sequence SEQ ID No: 4, which corresponds to the CDR3 region of the heavy chain commencing at amino acid 103 of NIH45-46 as shown in FIG. 5A, is substituted for the corresponding region, as determined by sequence alignment, of an HIV antibody of the invention. For example, SEQ ID No: 4 may be inserted after the fourth amino acid of CDR3 of the heavy chain.

In another embodiment, the present invention provides an isolated HIV antibody wherein insertion sequence SEQ ID No: 3, which corresponds to the FR3 region of the heavy chain commencing at amino acid 74 of 3BNC117 and 3BNC60 as shown in FIG. 5A, is substituted for the corresponding region, as determined by sequence alignment, of an HIV antibody of the invention, and insertion sequence SEQ ID No: 4, which corresponds to the CDR3 region of the heavy chain commencing at amino acid 103 of NIH45-46 as shown in FIG. 5A, is substituted for the corresponding region, as determined by sequence alignment, of an HIV antibody of the invention. For example, SEQ ID No: 3 may be inserted after the seventh amino acid of FR3 of the heavy chain and SEQ ID No: 4 may be inserted after the fourth amino acid of CDR3 of the heavy chain.

In a further embodiment, the present invention provides a method to improve the HIV neutralization potency and breadth of an isolated HIV antibody comprising making an isolated HIV antibody wherein insertion sequence SEQ ID No: 3, which corresponds to the FR3 region of the heavy commencing at amino acid 74 of 3BNC117 and 3BNC60 as shown in FIG. 5A, is substituted for the corresponding region, as determined by sequence alignment, of an HIV antibody of the invention and/or the insertion sequence SEQ ID No: 4, which corresponds to the CDR3 region of the heavy chain commencing at amino acid 103 of NIH45-46 as shown in FIG. 5A, is substituted for the corresponding region, as determined by sequence alignment, of an HIV antibody of the invention. For example, SEQ ID No: 3 may be inserted after the seventh amino acid of FR3 of the heavy chain, and/or SEQ ID No: 4 may be inserted after the fourth amino acid of CDR3 of the heavy chain. One skilled in this art can modify the amino acid sequence of an antibody utilizing recombinant methods and/or synthetic chemistry techniques for the production of a polypeptide or an antibody. Also, one skilled in the art can identify an improved HIV antibody with greater neutralization potency and breadth by using a HIV neutralization assay, as described below.

In another embodiment, the present invention provides an improved isolated HIV antibody comprising at least one of insertion sequences SEQ ID NO: 3 and SEQ ID NO: 4, wherein the improved isolated HIV antibody has greater HIV neutralization potency and breadth, than said isolated HIV antibody without insertion sequences SEQ ID NO: 3 and SEQ ID NO: 4. One skilled in the art can identify the improved HIV antibody with greater HIV neutralization potency and breadth by using the HIV neutralization assay, as described below.

One skilled in this art can modify the amino acid sequence of an antibody utilizing recombinant methods and/or synthetic chemistry techniques for the production of a polypeptide or an antibody.

In another embodiment, the present invention provides for a method to make an isolated HIV antibody comprising the heavy chain consensus sequence of SEQ ID NO:1 and the light chain sequence of SEQ ID NO:2. In a further embodiment, the present invention provides for a method of producing an isolated HIV antibody comprising one or both of the heavy chain consensus sequence of SEQ ID NO:1 and the light chain sequence of SEQ ID NO:2, or sequences having at least 70%, or at least 80%, or at least 85%, or at least 90%, or at least 95%, or at least 97%, or at least 98%, or at least 99% identity thereto, with the proviso that the antibody does not have the amino acid sequence of VRC01. Percentage identity is determined as disclosed hereinbelow.

In another embodiment, the present invention provides a method for detecting an isolated HIV antibody comprising obtaining an immunoglobulin-containing biological sample from a mammalian subject, isolating an HIV antibody from said sample, determining the amino sequence of the HIV antibody and identifying the presence of the heavy chain sequence of SEQ ID NO:1 and the light chain sequence of SEQ ID NO:2. In a further embodiment, the present invention provides for a method of selecting an isolated HIV antibody comprising determining the presence of one or both of the heavy chain consensus sequence of SEQ ID NO:1 and the light chain sequence of SEQ ID NO:2, or sequences having at least 70%, or at least 80%, or at least 85%, or at least 90%, or at least 95%, or at least 97%, or at least 98%, or at least 99% identity thereto, with the proviso that the antibody does not have the amino acid sequence of VRC01. Percentage identity is determined as disclosed herein below. The biological sample may be blood, serum, saliva, urine, sputum, a cell swab sample, or a tissue biopsy. The amino acid sequences may be determined by methods known in the art including, for example, PCR and mass spectrometry.

The term "antibody" (Ab) as used herein includes monoclonal antibodies, polyclonal antibodies, multispecific antibodies (for example, bispecific antibodies and polyreactive antibodies), and antibody fragments. Thus, the term "antibody" as used in any context within this specification is meant to include, but not be limited to, any specific binding member, immunoglobulin class and/or isotype (e.g., IgG1, IgG2, IgG3, IgG4, IgM, IgA, IgD, IgE and IgM); and biologically relevant fragment or specific binding member thereof, including but not limited to Fab, F(ab')2, Fv, and scFv (single chain or related entity). It is understood in the art that an antibody is a glycoprotein comprising at least two heavy (H) chains and two light (L) chains inter-connected by disulfide bonds, or an antigen binding portion thereof. A heavy chain is comprised of a heavy chain variable region (VH) and a heavy chain constant region (CH1, CH2 and CH3). A light chain is comprised of a light chain variable region (VL) and a light chain constant region (CL). The variable regions of both the heavy and light chains comprise framework regions (FWR) and complementarity determining regions (CDR). The four FWR regions are relatively conserved while CDR regions (CDR1, CDR2 and CDR3) represent hypervariable regions and are arranged from NH2 terminus to the COOH terminus as follows: FWR1, CDR1, FWR2, CDR2, FWR3, CDR3, FWR4. The variable regions of the heavy and light chains contain a binding domain that interacts with an antigen while, depending of the isotype, the constant region(s) may mediate the binding of the immunoglobulin to host tissues or factors.

Also included in the definition of "antibody" as used herein are chimeric antibodies, humanized antibodies, and recombinant antibodies, human antibodies generated from a transgenic non-human animal, as well as antibodies selected from libraries using enrichment technologies available to the artisan.

The term "variable" refers to the fact that certain segments of the variable (V) domains differ extensively in sequence among antibodies. The V domain mediates antigen binding and defines specificity of a particular antibody for its particular antigen. However, the variability is not evenly distributed across the 110-amino acid span of the variable regions. Instead, the V regions consist of relatively invariant stretches called framework regions (FRs) of 15-30 amino acids separated by shorter regions of extreme variability called "hypervariable regions" that are each 9-12 amino acids long. The variable regions of native heavy and light chains each comprise four FRs, largely adopting a beta sheet configuration, connected by three hypervariable regions, which form loops connecting, and in some cases forming part of, the beta sheet structure. The hypervariable regions in each chain are held together in close proximity by the FRs and, with the hypervariable regions from the other chain, contribute to the formation of the antigen-binding site of antibodies (see, for example, Kabat et al., Sequences of Proteins of Immunological Interest, 5th Ed. Public Health Service, National Institutes of Health, Bethesda, Md. (1991)).

The term "hypervariable region" as used herein refers to the amino acid residues of an antibody that are responsible for antigen binding. The hypervariable region generally comprises amino acid residues from a "complementarity determining region" ("CDR").

The term "monoclonal antibody" as used herein refers to an antibody obtained from a population of substantially homogeneous antibodies, i.e., the individual antibodies comprising the population are identical except for possible naturally occurring mutations that may be present in minor amounts. The term "polyclonal antibody" refers to preparations that include different antibodies directed against different determinants ("epitopes").

The monoclonal antibodies herein include "chimeric" antibodies in which a portion of the heavy and/or light chain is identical with, or homologous to, corresponding sequences in antibodies derived from a particular species or belonging to a particular antibody class or subclass, while the remainder of the chain(s) is identical with, or homologous to, corresponding sequences in antibodies derived from another species or belonging to another antibody class or subclass, as well as fragments of such antibodies, so long as they exhibit the desired biological activity (see, for example, U.S. Pat. No. 4,816,567; and Morrison et al., Proc. Natl. Acad. Sci. USA, 81:6851-6855 (1984)). The described invention provides variable region antigen-binding sequences derived from human antibodies. Accordingly, chimeric antibodies of primary interest herein include antibodies having one or more human antigen binding sequences (for example, CDRs) and containing one or more sequences derived from a non-human antibody, for example, an FR or C region sequence. In addition, chimeric antibodies included herein are those comprising a human variable region antigen binding sequence of one antibody class or subclass and another sequence, for example, FR or C region sequence, derived from another antibody class or subclass.

A "humanized antibody" generally is considered to be a human antibody that has one or more amino acid residues introduced into it from a source that is non-human. These non-human amino acid residues often are referred to as "import" residues, which typically are taken from an "import" variable region. Humanization may be performed following the method of Winter and co-workers (see, for example, Jones et al., Nature, 321:522-525 (1986); Reichmann et al., Nature, 332:323-327 (1988); Verhoeyen et al., Science, 239:1534-1536 (1988)), by substituting import hypervariable region sequences for the corresponding sequences of a human antibody. Accordingly, such "humanized" antibodies are chimeric antibodies (see, for example, U.S. Pat. No. 4,816,567), wherein substantially less than an intact human variable region has been substituted by the corresponding sequence from a non-human species.

An "antibody fragment" comprises a portion of an intact antibody, such as the antigen binding or variable region of the intact antibody. Examples of antibody fragments include, but are not limited to, Fab, Fab', F(ab')2, and Fv fragments; diabodies; linear antibodies (see, for example, U.S. Pat. No. 5,641,870; Zapata et al., Protein Eng. 8(10): 1057-1062 [1995]); single-chain antibody molecules; and multispecific antibodies formed from antibody fragments.

"Fv" is the minimum antibody fragment that contains a complete antigen-recognition and antigen-binding site. This fragment contains a dimer of one heavy- and one light-chain variable region domain in tight, non-covalent association. From the folding of these two domains emanate six hypervariable loops (three loops each from the H and L chain) that contribute the amino acid residues for antigen binding and confer antigen binding specificity to the antibody. However, even a single variable region (or half of an Fv comprising only three CDRs specific for an antigen) has the ability to recognize and bind antigen, although at a lower affinity than the entire binding site.

"Single-chain Fv" ("sFv" or "scFv") are antibody fragments that comprise the VH and VL antibody domains connected into a single polypeptide chain. The sFv polypeptide can further comprise a polypeptide linker between the VH and VL domains that enables the sFv to form the desired structure for antigen binding. For a review of sFv, see, for example, Pluckthun in The Pharmacology of Monoclonal Antibodies, vol. 113, Rosenburg and Moore eds., Springer-Verlag, New York, pp. 269-315 (1994); Borrebaeck 1995, infra.

The term "diabodies" refers to small antibody fragments prepared by constructing sFv fragments with short linkers (about 5-10 residues) between the VH and VL domains such that inter-chain but not intra-chain pairing of the V domains is achieved, resulting in a bivalent fragment, i.e., fragment having two antigen-binding sites. Bispecific diabodies are heterodimers of two "crossover" sFv fragments in which the VH and VL domains of the two antibodies are present on different polypeptide chains. Diabodies are described more fully in, for example, EP 404,097; WO 93/11161; and Hollinger et al., Proc. Natl. Acad. Sci. USA, 90:6444-6448 (1993).

Domain antibodies (dAbs), which can be produced in fully human form, are the smallest known antigen-binding fragments of antibodies, ranging from about 11 kDa to about 15 kDa. dAbs are the robust variable regions of the heavy and light chains of immunoglobulins (VH and VL, respectively). They are highly expressed in microbial cell culture, show favorable biophysical properties including, for example, but not limited to, solubility and temperature stability, and are well suited to selection and affinity maturation by in vitro selection systems such as, for example, phage display. dAbs are bioactive as monomers and, owing to their small size and inherent stability, can be formatted into larger molecules to create drugs with prolonged serum half-lives or other pharmacological activities. Examples of this technology have been described in, for example, WO9425591 for antibodies derived from Camelidae heavy chain Ig, as well in US20030130496 describing the isolation of single domain fully human antibodies from phage libraries.

Fv and sFv are the only species with intact combining sites that are devoid of constant regions. Thus, they are suitable for reduced nonspecific binding during in vivo use. sFv fusion proteins can be constructed to yield fusion of an effector protein at either the amino or the carboxy terminus of an sFv. See, for example, Antibody Engineering, ed. Borrebaeck, supra. The antibody fragment also can be a "linear antibody", for example, as described in U.S. Pat. No. 5,641,870 for example. Such linear antibody fragments can be monospecific or bispecific.

In certain embodiments, antibodies of the described invention are bispecific or multi-specific. Bispecific antibodies are antibodies that have binding specificities for at least two different epitopes. Exemplary bispecific antibodies can bind to two different epitopes of a single antigen. Other such antibodies can combine a first antigen binding site with a binding site for a second antigen. Alternatively, an anti-HIV arm can be combined with an arm that binds to a triggering molecule on a leukocyte, such as a T-cell receptor molecule (for example, CD3), or Fc receptors for IgG (Fc gamma R), such as Fc gamma RI (CD64), Fc gamma RII (CD32) and Fc gamma RIII (CD16), so as to focus and localize cellular defense mechanisms to the infected cell. Bispecific antibodies also can be used to localize cytotoxic agents to infected cells. Bispecific antibodies can be prepared as full length antibodies or antibody fragments (for example, F(ab')2 bispecific antibodies). For example, WO 96/16673 describes a bispecific anti-ErbB2/anti-Fc gamma RIII antibody and U.S. Pat. No. 5,837,234 discloses a bispecific anti-ErbB2/anti-Fc gamma RI antibody. For example, a bispecific anti-ErbB2/Fc alpha antibody is reported in WO98/02463; U.S. Pat. No. 5,821,337 teaches a bispecific anti-ErbB2/anti-CD3 antibody. See also, for example, Mouquet et al., Polyreactivity Increases The Apparent Affinity Of Anti-HIV Antibodies By Heteroligation. NATURE. 467, 591-5 (2010).

Methods for making bispecific antibodies are known in the art. Traditional production of full length bispecific antibodies is based on the co-expression of two immunoglobulin heavy chain-light chain pairs, where the two chains have different specificities (see, for example, Millstein et al., Nature, 305:537-539 (1983)). Similar procedures are disclosed in, for example, WO 93/08829, Traunecker et al., EMBO J., 10:3655-3659 (1991) and see also; Mouquet et al., Polyreactivity Increases The Apparent Affinity Of Anti-HIV Antibodies By Heteroligation. NATURE. 467, 591-5 (2010).

Alternatively, antibody variable regions with the desired binding specificities (antibody-antigen combining sites) are fused to immunoglobulin constant domain sequences. The fusion is with an Ig heavy chain constant domain, comprising at least part of the hinge, CH2, and CH3 regions. According to some embodiments, the first heavy-chain constant region (CH1) containing the site necessary for light chain bonding, is present in at least one of the fusions. DNAs encoding the immunoglobulin heavy chain fusions and, if desired, the immunoglobulin light chain, are inserted into separate expression vectors, and are co-transfected into a suitable host cell. This provides for greater flexibility in adjusting the mutual proportions of the three polypeptide fragments in embodiments when unequal ratios of the three polypeptide chains used in the construction provide the optimum yield of the desired bispecific antibody. It is, however, possible to insert the coding sequences for two or all three polypeptide chains into a single expression vector when the expression of at least two polypeptide chains in equal ratios results in high yields or when the ratios have no significant affect on the yield of the desired chain combination.

Techniques for generating bispecific antibodies from antibody fragments also have been described in the literature. For example, bispecific antibodies can be prepared using chemical linkage. For example, Brennan et al., Science, 229: 81 (1985) describe a procedure wherein intact antibodies are proteolytically cleaved to generate F(ab')2 fragments. These fragments are reduced in the presence of the dithiol complexing agent, sodium arsenite, to stabilize vicinal dithiols and prevent intermolecular disulfide formation. The Fab' fragments generated then are converted to thionitrobenzoate (TNB) derivatives. One of the Fab'-TNB derivatives then is reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Other modifications of the antibody are contemplated herein. For example, the antibody can be linked to one of a variety of nonproteinaceous polymers, for example, polyethylene glycol, polypropylene glycol, polyoxyalkylenes, or copolymers of polyethylene glycol and polypropylene glycol. The antibody also can be entrapped in microcapsules prepared, for example, by coacervation techniques or by interfacial polymerization (for example, hydroxymethylcellulose or gelatin-microcapsules and poly-(methylmethacylate)microcapsules, respectively), in colloidal drug delivery systems (for example, liposomes, albumin microspheres, microemulsions, nano-particles and nanocapsules), or in macroemulsions. Such techniques are disclosed in, for example, Remington's Pharmaceutical Sciences, 16th edition, Oslo, A., Ed., (1980).

Typically, the antibodies of the described invention are produced recombinantly, using vectors and methods available in the art. Human antibodies also can be generated by in vitro activated B cells (see, for example, U.S. Pat. Nos. 5,567,610 and 5,229,275). General methods in molecular genetics and genetic engineering useful in the present invention are described in the current editions of Molecular Cloning: A Laboratory Manual (Sambrook, et al., 1989, Cold Spring Harbor Laboratory Press), Gene Expression Technology (Methods in Enzymology, Vol. 185, edited by D. Goeddel, 1991. Academic Press, San Diego, Calif.), "Guide to Protein Purification" in Methods in Enzymology (M. P. Deutshcer, ed., (1990) Academic Press, Inc.); PCR Protocols: A Guide to Methods and Applications (Innis, et al. 1990. Academic Press, San Diego, Calif.), Culture of Animal Cells: A Manual of Basic Technique, 2nd Ed. (R. I. Freshney. 1987. Liss, Inc. New York, N.Y.), and Gene Transfer and Expression Protocols, pp. 109-128, ed. E. J. Murray, The Humana Press Inc., Clifton, N.J.). Reagents, cloning vectors, and kits for genetic manipulation are available from commercial vendors such as BioRad, Stratagene, Invitrogen, ClonTech and Sigma-Aldrich Co.

Human antibodies also can be produced in transgenic animals (for example, mice) that are capable of producing a full repertoire of human antibodies in the absence of endogenous immunoglobulin production. For example, it has been described that the homozygous deletion of the antibody heavy-chain joining region (JH) gene in chimeric and germ-line mutant mice results in complete inhibition of endogenous antibody production. Transfer of the human germ-line immunoglobulin gene array into such germ-line mutant mice results in the production of human antibodies upon antigen challenge. See, for example, Jakobovits et al., Proc. Natl. Acad. Sci. USA, 90:2551 (1993); Jakobovits et al., Nature, 362:255-258 (1993); Bruggemann et al., Year in Immuno., 7:33 (1993); U.S. Pat. Nos. 5,545,806, 5,569,825, 5,591,669 (all of GenPharm); U.S. Pat. No. 5,545,807; and WO 97/17852. Such animals can be genetically engineered to produce human antibodies comprising a polypeptide of the described invention.

Various techniques have been developed for the production of antibody fragments. Traditionally, these fragments were derived via proteolytic digestion of intact antibodies (see, for example, Morimoto et al., Journal of Biochemical and Biophysical Methods 24:107-117 (1992); and Brennan et al., Science, 229:81 (1985)). However, these fragments can now be produced directly by recombinant host cells. Fab, Fv and ScFv antibody fragments can all be expressed in and secreted from *E. coli*, thus allowing the facile production of large amounts of these fragments. Fab'-SH fragments can be directly recovered from *E. coli* and chemically coupled to form F(ab')2 fragments (see, for example, Carter et al., Bio/Technology 10:163-167 (1992)). According to another approach, F(ab')2 fragments can be isolated directly from recombinant host cell culture. Fab and F(ab')2 fragment with increased in vivo half-life comprising a salvage receptor binding epitope residues are described in U.S. Pat. No. 5,869,046. Other techniques for the production of antibody fragments will be apparent to the skilled practitioner.

Other techniques that are known in the art for the selection of antibody fragments from libraries using enrichment technologies, including but not limited to phage display, ribosome display (Hanes and Pluckthun, 1997, *Proc. Nat. Acad.*

Sci. 94: 4937-4942), bacterial display (Georgiou, et al., 1997, *Nature Biotechnology* 15: 29-34) and/or yeast display (Kieke, et al., 1997, *Protein Engineering* 10: 1303-1310) may be utilized as alternatives to previously discussed technologies to select single chain antibodies. Single-chain antibodies are selected from a library of single chain antibodies produced directly utilizing filamentous phage technology. Phage display technology is known in the art (e.g., see technology from Cambridge Antibody Technology (CAT)) as disclosed in U.S. Pat. Nos. 5,565,332; 5,733,743; 5,871,907; 5,872,215; 5,885,793; 5,962,255; 6,140,471; 6,225,447; 6,291650; 6,492,160; 6,521,404; 6,544,731; 6,555,313; 6,582,915; 6,593,081, as well as other U.S. family members, or applications which rely on priority filing GB 9206318, filed 24 May 1992; see also Vaughn, et al. 1996, Nature Biotechnology 14: 309-314). Single chain antibodies may also be designed and constructed using available recombinant DNA technology, such as a DNA amplification method (e.g., PCR), or possibly by using a respective hybridoma cDNA as a template.

Variant antibodies also are included within the scope of the invention. Thus, variants of the sequences recited in the application also are included within the scope of the invention. Further variants of the antibody sequences having improved affinity can be obtained using methods known in the art and are included within the scope of the invention. For example, amino acid substitutions can be used to obtain antibodies with further improved affinity. Alternatively, codon optimization of the nucleotide sequence can be used to improve the efficiency of translation in expression systems for the production of the antibody.

Such variant antibody sequences will share 70% or more (i.e., 80%, 85%, 90%, 95%, 97%, 98%, 99% or greater) sequence identity with the sequences recited in the application. Such sequence identity is calculated with regard to the full length of the reference sequence (i.e., the sequence recited in the application). Percentage identity, as referred to herein, is as determined using BLAST version 2.1.3 using the default parameters specified by the NCBI (the National Center for Biotechnology Information; http://www.ncbi.nlm.nih.gov/) [Blosum 62 matrix; gap open penalty=11 and gap extension penalty=1]. For example, peptide sequences are provided by this invention that comprise at least about 5, 10, 15, 20, 30, 40, 50, 75, 100, 150, or more contiguous peptides of one or more of the sequences disclosed herein as well as all intermediate lengths there between. As used herein, the term "intermediate lengths" is meant to describe any length between the quoted values, such as 7, 8, 9, 10, 11, 12, 13, 14, 15, 16, 17, 18, 19, etc.; 21, 22, 23, etc.; 30, 31, 32, etc.; 50, 51, 52, 53, etc.; 100, 101, 102, 103, etc.; 150, 151, 152, 153, etc.

The present invention provides for antibodies, either alone or in combination with other antibodies, such as, but not limited to, VRC01 and PG9, that have broad neutralizing activity in serum.

According to another embodiment, the present invention provides methods for the preparation and administration of an HIV antibody composition that is suitable for administration to a human or non-human primate patient having HIV infection, or at risk of HIV infection, in an amount and according to a schedule sufficient to induce a protective immune response against HIV, or reduction of the HIV virus, in a human.

According to another embodiment, the present invention provides a vaccine comprising at least one antibody of the invention and a pharmaceutically acceptable carrier. According to one embodiment, the vaccine is a vaccine comprising at least one antibody described herein and a pharmaceutically acceptable carrier. The vaccine can include a plurality of the antibodies having the characteristics described herein in any combination and can further include antibodies neutralizing to HIV as are known in the art.

It is to be understood that compositions can be a single or a combination of antibodies disclosed herein, which can be the same or different, in order to prophylactically or therapeutically treat the progression of various subtypes of HIV infection after vaccination. Such combinations can be selected according to the desired immunity. When an antibody is administered to an animal or a human, it can be combined with one or more pharmaceutically acceptable carriers, excipients or adjuvants as are known to one of ordinary skilled in the art. The composition can further include broadly neutralizing antibodies known in the art, including but not limited to, VRC01, PG9 and b12.

Further, with respect to determining the effective level in a patient for treatment of HIV, in particular, suitable animal models are available and have been widely implemented for evaluating the in vivo efficacy against HIV of various gene therapy protocols (Sarver et al. (1993b), supra). These models include mice, monkeys and cats. Even though these animals are not naturally susceptible to HIV disease, chimeric mice models (for example, SCID, bg/nu/xid, NOD/SCID, SCID-hu, immunocompetent SCID-hu, bone marrow-ablated BALB/c) reconstituted with human peripheral blood mononuclear cells (PBMCs), lymph nodes, fetal liver/thymus or other tissues can be infected with lentiviral vector or HIV, and employed as models for HIV pathogenesis. Similarly, the simian immune deficiency virus (SIV)/monkey model can be employed, as can the feline immune deficiency virus (FIV)/cat model. The pharmaceutical composition can contain other pharmaceuticals, in conjunction with a vector according to the invention, when used to therapeutically treat AIDS. These other pharmaceuticals can be used in their traditional fashion (i.e., as antiviral agents to treat HIV infection). Examples of HIV agents include without limitation non-nucleoside reverse transcriptase inhibitors, protease inhibitors, entry or fusion inhibitors and integrase inhibitors According to another embodiment, the present invention provides an antibody-based pharmaceutical composition comprising an effective amount of an isolated HIV antibody, or an affinity matured version, which provides a prophylactic or therapeutic treatment choice to reduce infection of the HIV virus. The antibody-based pharmaceutical composition of the present invention may be formulated by any number of strategies known in the art (e.g., see McGoff and Scher, 2000, Solution Formulation of Proteins/Peptides: In McNally, E. J., ed. Protein Formulation and Delivery. New York, N.Y.: Marcel Dekker; pp. 139-158; Akers and Defilippis, 2000, Peptides and Proteins as Parenteral Solutions. In: Pharmaceutical Formulation Development of Peptides and Proteins. Philadelphia, Pa.: Talyor and Francis; pp. 145-177; Akers, et al., 2002, Pharm. Biotechnol. 14:47-127). A pharmaceutically acceptable composition suitable for patient administration will contain an effective amount of the antibody in a formulation which both retains biological activity while also promoting maximal stability during storage within an acceptable temperature range. The pharmaceutical compositions can also include, depending on the formulation desired, pharmaceutically acceptable diluents, pharmaceutically acceptable carriers and/or pharmaceutically acceptable excipients, or any such vehicle commonly used to formulate pharmaceutical compositions for animal or human administration. The diluent is selected so as not to affect the biological activity of the combination. Examples of such diluents are distilled water, physiological phosphate-buffered saline, Ringer's solutions, dextrose solution, and Hank's solution. The amount of an excipient that is useful in the pharmaceutical composition or formulation of this invention is an amount that serves to uniformly distribute the antibody throughout the composition so that it can be uniformly dispersed when it is to be delivered to a subject in need thereof. It may serve to dilute the antibody to a concentration which provides the desired beneficial palliative or curative results while at the same time minimizing any adverse side effects that might occur from too high a concentration. It may also have a preservative effect. Thus, for the antibody having a high physiological activity, more of the excipient will be employed. On the other hand, for any active ingredient(s) that exhibit a lower physiological activity, a lesser quantity of the excipient will be employed.

The above described antibodies and antibody compositions or vaccine compositions, comprising at least one or a combination of the antibodies described herein, can be administered for the prophylactic and therapeutic treatment of HIV viral infection.

Figure 10A:
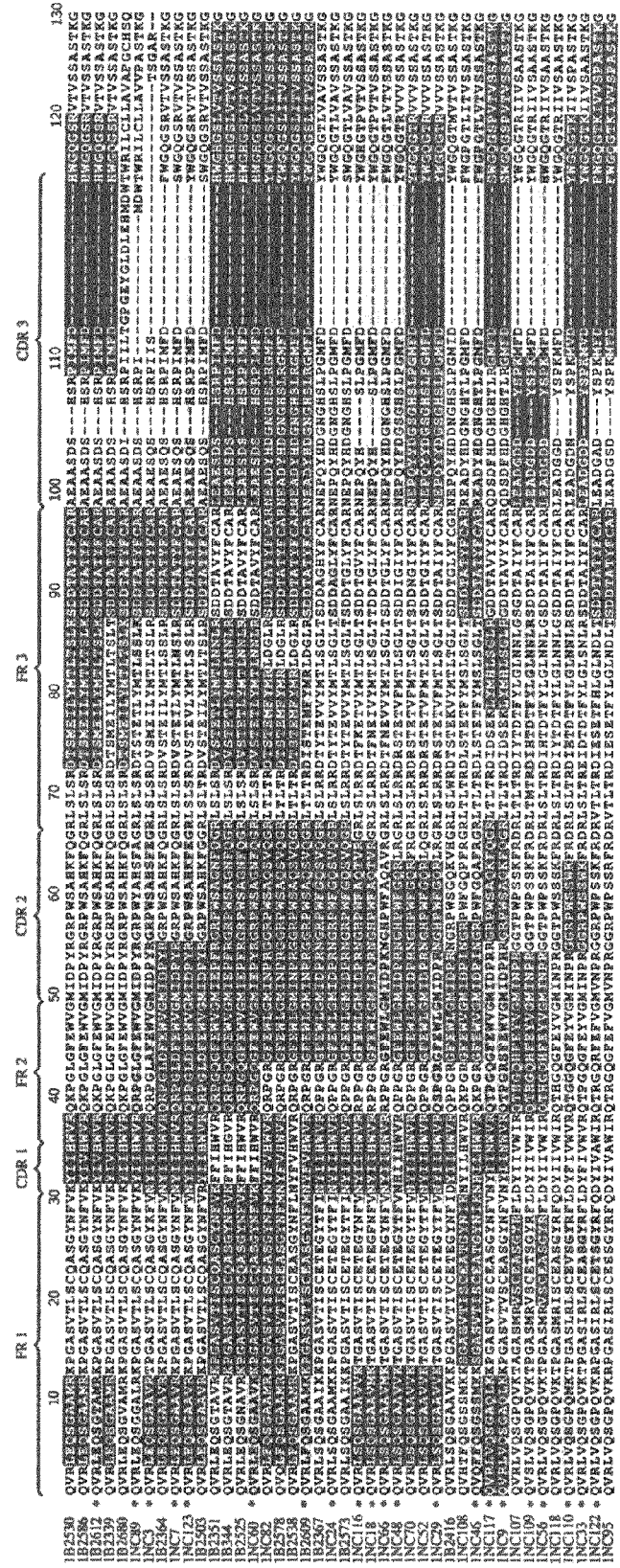
FIG. 10A discloses SEQ ID NOS 1020-1061.
Figure 10B:
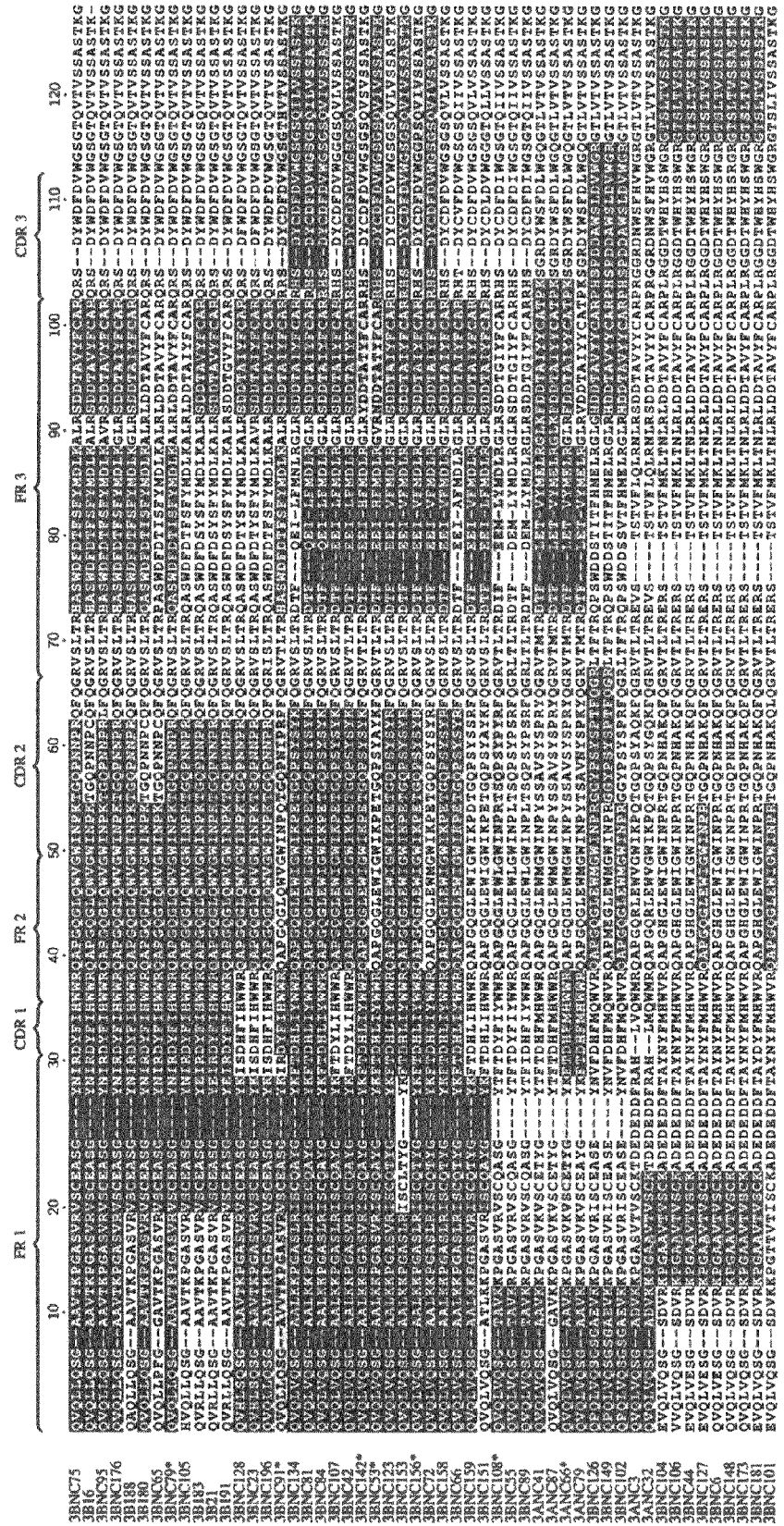
FIG. 10B discloses SEQ ID NOS 1062-1113.
Figure 10C:
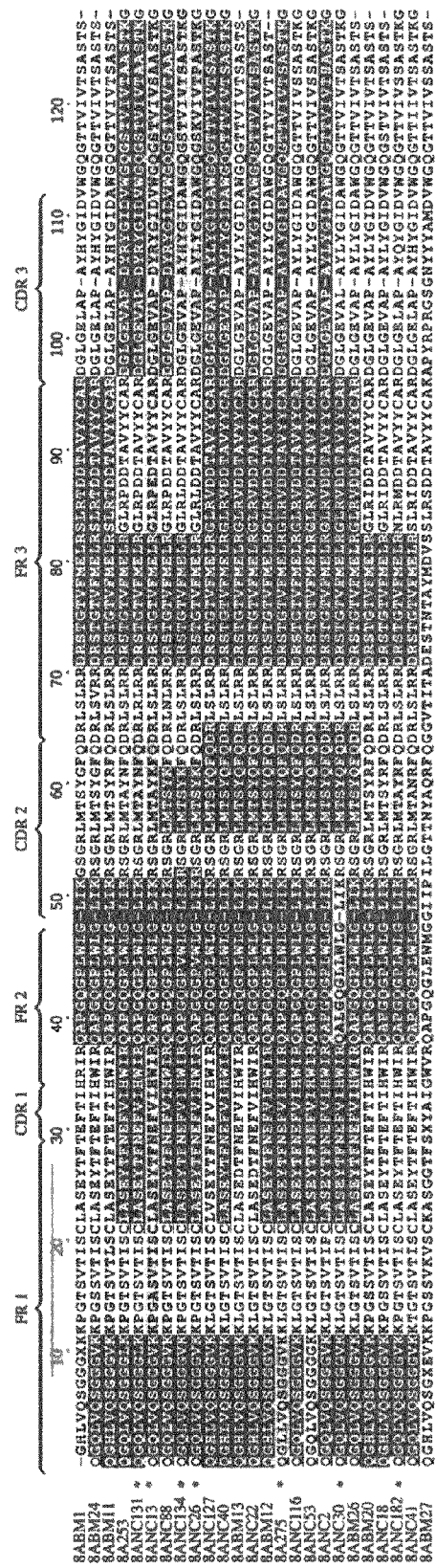
FIG. 10C discloses SEQ ID NOS 1114-1138, all respectively, in order of appearance.

The present invention also relates to isolated polypeptides comprising the amino acid sequences of the light chains and heavy chains listed in Tables A,B and FIGS. 10 A-C; the consensus sequences for the heavy and light chains of SEQ ID NOs: 1 and 2; and insertion sequences SEQ ID NOs:3 and 4.

In other related embodiments, the invention provides polypeptide variants that encode the amino acid sequences of the HIV antibodies listed in Tables A,B and FIG. 10 A-C; the consensus sequences for the heavy and light chains of SEQ ID NOs: 1 and 2; and insertion sequences SEQ ID NOs:3 and 4. These polypeptide variants have at least 70%, at least 75%, at least 80%, at least 85%, at least 90%, at least 95%, at least 96%, at least 97%, at least 98%, or at least 99%, or greater, sequence identity compared to a polypeptide sequence of this invention, as determined using the methods described herein, (for example, BLAST analysis using standard parameters). One skilled in this art will recognize that these values can be appropriately adjusted to determine corresponding identity of proteins encoded by taking into amino acid similarity and the like.

The term "polypeptide" is used in its conventional meaning, i.e., as a sequence of amino acids. The polypeptides are not limited to a specific length of the product. Peptides, oligopeptides, and proteins are included within the definition of polypeptide, and such terms can be used interchangeably herein unless specifically indicated otherwise. This term also includes post-expression modifications of the polypeptide, for example, glycosylations, acetylations, phosphorylations and the like, as well as other modifications known in the art, both naturally occurring and non-naturally occurring. A polypeptide can be an entire protein, or a subsequence thereof. Particular polypeptides of interest in the context of this invention are amino acid subsequences comprising CDRs, VH and VL, being capable of binding an antigen or HIV-infected cell.

A polypeptide "variant," as the term is used herein, is a polypeptide that typically differs from a polypeptide specifically disclosed herein in one or more substitutions, deletions, additions and/or insertions. Such variants can be naturally occurring or can be synthetically generated, for example, by modifying one or more of the above polypeptide sequences of the invention and evaluating one or more biological activities of the polypeptide as described herein and/or using any of a number of techniques well known in the art.

For example, certain amino acids can be substituted for other amino acids in a protein structure without appreciable loss of its ability to bind other polypeptides (for example, antigens) or cells. Since it is the binding capacity and nature of a protein that defines that protein's biological functional activity, certain amino acid sequence substitutions can be made in a protein sequence, and, accordingly, its underlying DNA coding sequence, whereby a protein with like properties is obtained. It is thus contemplated that various changes can be made in the peptide sequences of the disclosed compositions, or corresponding DNA sequences that encode said peptides without appreciable loss of their biological utility or activity.

In many instances, a polypeptide variant will contain one or more conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged.

Amino acid substitutions generally are based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

"Homology" or "sequence identity" refers to the percentage of residues in the polynucleotide or polypeptide sequence variant that are identical to the non-variant sequence after aligning the sequences and introducing gaps, if necessary, to achieve the maximum percent homology. In particular embodiments, polynucleotide and polypeptide variants have at least about 70%, at least about 75%, at least about 80%, at least about 90%, at least about 95%, at least about 98%, or at least about 99% polynucleotide or polypeptide homology with a polynucleotide or polypeptide described herein.

Such variant polypeptide sequences will share 70% or more (i.e. 80%, 85%, 90%, 95%, 97%, 98%, 99% or more) sequence identity with the sequences recited in the application. In additional embodiments, the described invention provides polypeptide fragments comprising various lengths of contiguous stretches of amino acid sequences disclosed herein. For example, peptide sequences are provided by this invention that comprise at least about 5, 10, 15, 20, 30, 40, 50, 75, 100, 150, or more contiguous peptides of one or more of the sequences disclosed herein as well as all intermediate lengths there between.

The invention also includes nucleic acid sequences encoding part or all of the light and heavy chains of the described inventive antibodies, and fragments thereof. Due to redundancy of the genetic code, variants of these sequences will exist that encode the same amino acid sequences.

The present invention also includes isolated nucleic acid sequences encoding the polypeptides for the heavy and light chains of the HIV antibodies listed in Tables A,B and FIG. 10 A-C; the consensus sequences for the heavy and light chains of SEQ ID NOs: 1 and 2; and insertion sequences SEQ ID NOs:3 and 4.

In other related embodiments, the described invention provides polynucleotide variants that encode the peptide sequences of the heavy and light chains of the HIV antibodies listed in Tables A,B and FIGS. 10 A-C; the consensus sequences for the heavy and light chains of SEQ ID NOs: 1 and 2; and insertion sequences SEQ ID NOs:3 and 4. These polynucleotide variants have at least 70%, at least 75%, at least 80%, at least 85%, at least 90%, at least 95%, at least 96%, at least 97%, at least 98%, or at least 99%, or greater, sequence identity compared to a polynucleotide sequence of this invention, as determined using the methods described herein, (for example, BLAST analysis using standard parameters). One skilled in this art will recognize that these values can be appropriately adjusted to determine corresponding identity of proteins encoded by two nucleotide sequences by taking into account codon degeneracy, amino acid similarity, reading frame positioning, and the like.

The terms "nucleic acid" and "polynucleotide" are used interchangeably herein to refer to single-stranded or double-stranded RNA, DNA, or mixed polymers. Polynucleotides can include genomic sequences, extra-genomic and plasmid sequences, and smaller engineered gene segments that express, or can be adapted to express polypeptides.

An "isolated nucleic acid" is a nucleic acid that is substantially separated from other genome DNA sequences as well as proteins or complexes such as ribosomes and polymerases, which naturally accompany a native sequence. The term encompasses a nucleic acid sequence that has been removed from its naturally occurring environment, and includes recombinant or cloned DNA isolates and chemically synthesized analogues or analogues biologically synthesized by heterologous systems. A substantially pure nucleic acid includes isolated forms of the nucleic acid. Accordingly, this refers to the nucleic acid as originally isolated and does not exclude genes or sequences later added to the isolated nucleic acid by the hand of man.

A polynucleotide "variant," as the term is used herein, is a polynucleotide that typically differs from a polynucleotide specifically disclosed herein in one or more substitutions, deletions, additions and/or insertions. Such variants can be naturally occurring or can be synthetically generated, for example, by modifying one or more of the polynucleotide sequences of the invention and evaluating one or more biological activities of the encoded polypeptide as described herein and/or using any of a number of techniques well known in the art.

Modifications can be made in the structure of the polynucleotides of the described invention and still obtain a functional molecule that encodes a variant or derivative polypeptide with desirable characteristics. When it is desired to alter the amino acid sequence of a polypeptide to create an equivalent, or even an improved, variant or portion of a polypeptide of the invention, one skilled in the art typically will change one or more of the codons of the encoding DNA sequence.

Typically, polynucleotide variants contain one or more substitutions, additions, deletions and/or insertions, such that the immunogenic binding properties of the polypeptide encoded by the variant polynucleotide is not substantially diminished relative to a polypeptide encoded by a polynucleotide sequence specifically set forth herein.

In additional embodiments, the described invention provides polynucleotide fragments comprising various lengths of contiguous stretches of sequence identical to or complementary to one or more of the sequences disclosed herein. For example, polynucleotides are provided by this invention that comprise at least about 10, 15, 20, 30, 40, 50, 75, 100, 150, 200, 300, 400, 500 or 1000 or more contiguous nucleotides of one or more of the sequences disclosed herein as well as all intermediate lengths there between and encompass any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; and including all integers through 200-500; 500-1,000.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderate stringent conditions for testing the hybridization of a polynucleotide of this invention with other polynucleotides include prewashing in a solution of 5×SSC, 0.5% SDS, 1.0 mM EDTA (pH 8.0); hybridizing at 50-60° C., 5×SSC, overnight; followed by washing twice at 65° C. for 20 minutes with each of 2×, 0.5×, and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, for example, to 60-65° C. or 65-70° C.

In some embodiments, the polypeptide encoded by the polynucleotide variant or fragment has the same binding specificity (i.e., specifically or preferentially binds to the same epitope or HIV strain) as the polypeptide encoded by the native polynucleotide. In some embodiments, the described polynucleotides, polynucleotide variants, fragments and hybridizing sequences, encode polypeptides that have a level of binding activity of at least about 50%, at least about 70%, and at least about 90% of that for a polypeptide sequence specifically set forth herein.

The polynucleotides of the described invention, or fragments thereof, regardless of the length of the coding sequence itself, can be combined with other DNA sequences, such as promoters, polyadenylation signals, additional restriction enzyme sites, multiple cloning sites, other coding segments, and the like, such that their overall length can vary considerably. A nucleic acid fragment of almost any length is employed. For example, illustrative polynucleotide segments with total lengths of about 10000, about 5000, about 3000, about 2000, about 1000, about 500, about 200, about 100, about 50 base pairs in length, and the like, (including all intermediate lengths) are included in many implementations of this invention.

In some embodiments, the polynucleotide sequences provided herein are used as probes or primers for nucleic acid hybridization, for example, as PCR primers. The ability of such nucleic acid probes to specifically hybridize to a sequence of interest enables them to detect the presence of complementary sequences in a given sample. However, other uses also are encompassed by the described invention, such as the use of the sequence information for the preparation of mutant species primers, or primers for use in preparing other genetic constructions. As such, nucleic acid segments of the described invention that include a sequence region of at least about a 15 nucleotide long contiguous sequence that has the same sequence as, or is complementary to, a 15 nucleotide long contiguous sequence disclosed herein is particularly useful. Longer contiguous identical or complementary sequences, for example, those of about 20, 30, 40, 50, 100, 200, 500, 1000 (including all intermediate lengths) including full length sequences, and all lengths in between, also are used in some embodiments.

Polynucleotide molecules having sequence regions consisting of contiguous nucleotide stretches of 10-14, 15-20, 30, 50, or even of 100-200 nucleotides or so (including intermediate lengths as well), identical or complementary to a polynucleotide sequence disclosed herein, are particularly contemplated as hybridization probes for use in, for example, Southern and Northern blotting, and/or primers for use in, for example, PCR. The total size of fragment, as well as the size of the complementary stretch(es), ultimately depends on the intended use or application of the particular nucleic acid segment. Smaller fragments generally are used in hybridization embodiments, wherein the length of the contiguous complementary region can be varied, such as between about 15 and about 100 nucleotides, but larger contiguous complementarity stretches can be used, according to the length complementary sequences one wishes to detect.

The use of a hybridization probe of about 15-25 nucleotides in length allows the formation of a duplex molecule that is both stable and selective. Molecules having contiguous complementary sequences over stretches greater than 12 bases in length can be utilized, though, in order to increase stability and selectivity of the hybrid, and thereby improve the quality and degree of specific hybrid molecules obtained. Nucleic acid molecules having gene-complementary stretches of 15 to 25 contiguous nucleotides, or even longer where desired, can be utilized.

Hybridization probes are selected from any portion of any of the sequences disclosed herein. All that is required is to review the sequences set forth herein, or to any continuous portion of the sequences, from about 15-25 nucleotides in length up to and including the full length sequence, that one wishes to utilize as a probe or primer. The choice of probe and primer sequences is governed by various factors. For example, one may wish to employ primers from towards the termini of the total sequence.

Further included within the scope of the invention are vectors such as expression vectors, comprising a nucleic acid sequence according to the invention. Cells transformed with such vectors also are included within the scope of the invention.

The present invention also provides vectors and host cells comprising a nucleic acid of the invention, as well as recombinant techniques for the production of a polypeptide of the invention. Vectors of the invention include those capable of replication in any type of cell or organism, including, for example, plasmids, phage, cosmids, and mini chromosomes. In some embodiments, vectors comprising a polynucleotide of the described invention are vectors suitable for propagation or replication of the polynucleotide, or vectors suitable for expressing a polypeptide of the described invention. Such vectors are known in the art and commercially available.

"Vector" includes shuttle and expression vectors. Typically, the plasmid construct also will include an origin of replication (for example, the ColE1 origin of replication) and a selectable marker (for example, ampicillin or tetracycline resistance), for replication and selection, respectively, of the plasmids in bacteria. An "expression vector" refers to a vector that contains the necessary control sequences or regulatory elements for expression of the antibodies including antibody fragment of the invention, in bacterial or eukaryotic cells.

As used herein, the term "cell" can be any cell, including, but not limited to, that of a eukaryotic, multicellular species (for example, as opposed to a unicellular yeast cell), such as, but not limited to, a mammalian cell or a human cell. A cell can be present as a single entity, or can be part of a larger collection of cells. Such a "larger collection of cells" can comprise, for example, a cell culture (either mixed or pure), a tissue (for example, endothelial, epithelial, mucosa or other tissue), an organ (for example, lung, liver, muscle and other organs), an organ system (for example, circulatory system, respiratory system, gastrointestinal system, urinary system, nervous system, integumentary system or other organ system), or an organism (e.g., a bird, mammal, or the like).

Polynucleotides of the invention may synthesized, whole or in parts that then are combined, and inserted into a vector using routine molecular and cell biology techniques, including, for example, subcloning the polynucleotide into a linearized vector using appropriate restriction sites and restriction enzymes. Polynucleotides of the described invention are amplified by polymerase chain reaction using oligonucleotide primers complementary to each strand of the polynucleotide. These primers also include restriction enzyme cleavage sites to facilitate subcloning into a vector. The replicable vector components generally include, but are not limited to, one or more of the following: a signal sequence, an origin of replication, and one or more marker or selectable genes.

In order to express a polypeptide of the invention, the nucleotide sequences encoding the polypeptide, or functional equivalents, may be inserted into an appropriate expression vector, i.e., a vector that contains the necessary elements for the transcription and translation of the inserted coding sequence. Methods well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described, for example, in Sambrook, J., et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

The present invention also provides kits useful in performing diagnostic and prognostic assays using the antibodies, polypeptides and nucleic acids of the present invention. Kits of the present invention include a suitable container comprising an HIV antibody, a polypeptide or a nucleic acid of the invention in either labeled or unlabeled form. In addition, when the antibody, polypeptide or nucleic acid is supplied in a labeled form suitable for an indirect binding assay, the kit further includes reagents for performing the appropriate indirect assay. For example, the kit may include one or more suitable containers including enzyme substrates or derivatizing agents, depending on the nature of the label. Control samples and/or instructions may also be included. The present invention also provide kits for detecting the presence of the HIV antibodies or the nucleotide sequence of the HIV antibody of the present invention in a biological sample by PCR or mass spectrometry.

"Label" as used herein refers to a detectable compound or composition that is conjugated directly or indirectly to the antibody so as to generate a "labeled" antibody. A label can also be conjugated to a polypeptide and/or a nucleic acid sequence disclosed herein. The label can be detectable by itself (for example, radioisotope labels or fluorescent labels) or, in the case of an enzymatic label, can catalyze chemical alteration of a substrate compound or composition that is detectable. Antibodies and polypeptides of the described invention also can be modified to include an epitope tag or label, for example, for use in purification or diagnostic applications. Suitable detection means include the use of labels such as, but not limited to, radionucleotides, enzymes, coenzymes, fluorescers, chemiluminescers, chromogens, enzyme substrates or co-factors, enzyme inhibitors, prosthetic group complexes, free radicals, particles, dyes, and the like.

According to another embodiment, the present invention provides diagnostic methods. Diagnostic methods generally involve contacting a biological sample obtained from a patient, such as, for example, blood, serum, saliva, urine, sputum, a cell swab sample, or a tissue biopsy, with an HIV antibody and determining whether the antibody preferentially binds to the sample as compared to a control sample or predetermined cut-off value, thereby indicating the presence of the HIV virus.

According to another embodiment, the present invention provides methods to detect the presence of the HIV antibodies of the present invention in a biological sample from a patient. Detection methods generally involve obtaining a biological sample from a patient, such as, for example, blood, serum, saliva, urine, sputum, a cell swab sample, or a tissue biopsy and isolating HIV antibodies or fragments thereof, or the nucleic acids that encode an HIV antibody, and assaying for the presence of an HIV antibody in the biological sample. Also, the present invention provides methods to detect the nucleotide sequence of an HIV antibody in a cell. The nucleotide sequence of an HIV antibody may also be detected using the primers disclosed herein. The presence of the HIV antibody in a biological sample from a patient may be determined utilizing known recombinant techniques and/or the use of a mass spectrometer.

In another embodiment, the present invention provides a method for detecting an HIV antibody comprising a heavy chain comprising a highly conserved consensus sequence and a light chain comprising a highly conserved consensus sequence in a biological sample, comprising obtaining an immunoglobulin-containing biological sample from a mammalian subject, isolating an HIV antibody from said sample, and identifying the highly conserved consensus sequences of the heavy chain and the light chain. The biological sample may be blood, serum, saliva, urine, sputum, a cell swab sample, or a tissue biopsy. The amino acid sequences may be determined by methods known in the art including, for example, PCR and mass spectrometry.

The term "assessing" includes any form of measurement, and includes determining if an element is present or not. The terms "determining", "measuring", "evaluating", "assessing" and "assaying" are used interchangeably and include quantitative and qualitative determinations. Assessing may be relative or absolute. "Assessing the presence of" includes determining the amount of something present, and/or determining whether it is present or absent. As used herein, the terms "determining," "measuring," and "assessing," and "assaying" are used interchangeably and include both quantitative and qualitative determinations.

II. Method of Reducing Viral Replication

Methods for reducing an increase in HIV virus titer, virus replication, virus proliferation or an amount of an HIV viral protein in a subject are further provided. According to another aspect, a method includes administering to the subject an amount of an HIV antibody effective to reduce an increase in HIV titer, virus replication or an amount of an HIV protein of one or more HIV strains or isolates in the subject.

According to another embodiment, the present invention provides a method of reducing viral replication or spread of HIV infection to additional host cells or tissues comprising contacting a mammalian cell with the antibody, or a portion thereof, which binds to an antigenic epitope on gp120.

III. Method of Treatment

According to another embodiment, the present invention provides a method for treating a mammal infected with a virus infection, such as, for example, HIV, comprising administering to said mammal a pharmaceutical composition comprising the HIV antibodies disclosed herein. According to one embodiment, the method for treating a mammal infected with HIV comprises administering to said mammal a pharmaceutical composition that comprises an antibody of the present invention, or a fragment thereof. The compositions of the invention can include more than one antibody having the characteristics disclosed (for example, a plurality or pool of antibodies). It also can include other HIV neutralizing antibodies as are known in the art, for example, but not limited to, VRC01, PG9 and b12.

Passive immunization has proven to be an effective and safe strategy for the prevention and treatment of viral diseases. (See, for example, Keller et al., Clin. Microbiol. Rev. 13:602-14 (2000); Casadevall, Nat. Biotechnol. 20:114 (2002); Shibata et al., Nat. Med. 5:204-10 (1999); and Igarashi et al., Nat. Med. 5:211-16 (1999), each of which are incorporated herein by reference). Passive immunization using human monoclonal antibodies provides an immediate treatment strategy for emergency prophylaxis and treatment of HIV.

Subjects at risk for HIV-related diseases or disorders include patients who have come into contact with an infected person or who have been exposed to HIV in some other way. Administration of a prophylactic agent can occur prior to the manifestation of symptoms characteristic of HIV-related disease or disorder, such that a disease or disorder is prevented or, alternatively, delayed in its progression.

For in vivo treatment of human and non-human patients, the patient is administered or provided a pharmaceutical formulation including an HIV antibody of the invention. When used for in vivo therapy, the antibodies of the invention are administered to the patient in therapeutically effective amounts (i.e., amounts that eliminate or reduce the patient's viral burden). The antibodies are administered to a human patient, in accord with known methods, such as intravenous administration, for example, as a bolus or by continuous infusion over a period of time, by intramuscular, intraperitoneal, intracerobrospinal, subcutaneous, intra-articular, intrasynovial, intrathecal, oral, topical, or inhalation routes. The antibodies can be administered parenterally, when possible, at the target cell site, or intravenously. In some embodiments, antibody is administered by intravenous or subcutaneous administration. Therapeutic compositions of the invention may be administered to a patient or subject systemically, parenterally, or locally. The above parameters for assessing successful treatment and improvement in the disease are readily measurable by routine procedures familiar to a physician.

For parenteral administration, the antibodies may formulated in a unit dosage injectable form (solution, suspension, emulsion) in association with a pharmaceutically acceptable, parenteral vehicle. Examples of such vehicles include, but are not limited, water, saline, Ringer's solution, dextrose solution, and 5% human serum albumin. Nonaqueous vehicles include, but are not limited to, fixed oils and ethyl oleate. Liposomes can be used as carriers. The vehicle may contain minor amounts of additives such as substances that enhance isotonicity and chemical stability, such as, for example, buffers and preservatives. The antibodies can be formulated in such vehicles at concentrations of about 1 mg/ml to 10 mg/ml.

The dose and dosage regimen depends upon a variety of factors readily determined by a physician, such as the nature of the infection, for example, its therapeutic index, the patient, and the patient's history. Generally, a therapeutically effective amount of an antibody is administered to a patient. In some embodiments, the amount of antibody administered is in the range of about 0.1 mg/kg to about 50 mg/kg of patient body weight. Depending on the type and severity of the infection, about 0.1 mg/kg to about 50 mg/kg body weight (for example, about 0.1-15 mg/kg/dose) of antibody is an initial candidate dosage for administration to the patient, whether, for example, by one or more separate administrations, or by continuous infusion. The progress of this therapy is readily monitored by conventional methods and assays and based on criteria known to the physician or other persons of skill in the art. The above parameters for assessing successful treatment and improvement in the disease are readily measurable by routine procedures familiar to a physician.

Other therapeutic regimens may be combined with the administration of the HIV antibody of the present invention. The combined administration includes co-administration, using separate formulations or a single pharmaceutical formulation, and consecutive administration in either order, wherein preferably there is a time period while both (or all) active agents simultaneously exert their biological activities. Such combined therapy can result in a synergistic therapeutic effect. The above parameters for assessing successful treatment and improvement in the disease are readily measurable by routine procedures familiar to a physician.

The terms "treating" or "treatment" or "alleviation" are used interchangeably and refer to both therapeutic treatment and prophylactic or preventative measures; wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" for an infection if, after receiving a therapeutic amount of an antibody according to the methods of the present invention, the patient shows observable and/or measurable reduction in or absence of one or more of the following: reduction in the number of infected cells or absence of the infected cells; reduction in the percent of total cells that are infected; and/or relief to some extent, one or more of the symptoms associated with the specific infection; reduced morbidity and mortality, and improvement in quality of life issues. The above parameters for assessing successful treatment and improvement in the disease are readily measurable by routine procedures familiar to a physician.

The term "therapeutically effective amount" refers to an amount of an antibody or a drug effective to treat a disease or disorder in a subject or mammal.

Administration "in combination with" one or more further therapeutic agents includes simultaneous (concurrent) and consecutive administration in any order.

"Carriers" as used herein include pharmaceutically acceptable carriers, excipients, or stabilizers that are nontoxic to the cell or mammal being exposed thereto at the dosages and concentrations employed. Often the physiologically acceptable carrier is an aqueous pH buffered solution. Examples of physiologically acceptable carriers include, but not limited to, buffers such as phosphate, citrate, and other organic acids; antioxidants including, but not limited to, ascorbic acid; low molecular weight (less than about 10 residues) polypeptide; proteins, such as, but not limited to, serum albumin, gelatin, or immunoglobulins; hydrophilic polymers such as, but not limited to, polyvinylpyrrolidone; amino acids such as, but not limited to, glycine, glutamine, asparagine, arginine or lysine; monosaccharides, disaccharides, and other carbohydrates including, but not limited to, glucose, mannose, or dextrins; chelating agents such as, but not limited to, EDTA; sugar alcohols such as, but not limited to, mannitol or sorbitol; salt-forming counterions such as, but not limited to, sodium; and/or nonionic surfactants such as, but not limited to, polyoxyethylenesorbitan monolaurate (e. g. TWEEN); polyethylene glycol (PEG), and poloxamers (e.g. PLURONICS).

Where a value of ranges is provided, it is understood that each intervening value, to the tenth of the unit of the lower limit unless the context clearly dictates otherwise, between the upper and lower limit of that range and any other stated or intervening value in that stated range is encompassed within the invention. The upper and lower limits of these smaller ranges which may independently be included in the smaller ranges is also encompassed within the invention, subject to any specifically excluded limit in the stated range. Where the stated range includes one or both of the limits, ranges excluding either both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference in their entireties.

As used herein and in the appended claims, the singular forms "a", "and" and "the" include plural references unless the context clearly dictates otherwise Publications disclosed herein are provided solely for their disclosure prior to the filing date of the present invention. Nothing herein is to be construed as an admission that the present invention is not entitled to antedate such publication by virtue of prior invention. Further, the dates of publication provided may be different from the actual publication dates which may need to be independently confirmed.

Each of the applications and patents cited in this text, as well as each document or reference, patient or non-patient literature, cited in each of the applications and patents (including during the prosecution of each issued patent; "application cited documents"), and each of the PCT and foreign applications or patents corresponding to and/or claiming priority from any of these applications and patents, and each of the documents cited or referenced in each of the application cited documents, are hereby expressly incorporated herein by reference in their entirety. More generally, documents or references are cited in this text, either in a Reference List before the claims; or in the text itself; and, each of these documents or references ("herein-cited references"), as well as each document or reference cited in each of the herein-cited references (including any manufacturer's specifications, instructions, etc.), is hereby expressly incorporated herein by reference.

The following non-limiting examples serve to further illustrate the present invention.

Example 1

Materials, Methods and Instrumentation

Samples. Human samples were collected after signed informed consent in accordance with Institutional Review Board (IRB)-reviewed protocols by all participating institutions. Patient 1 was selected from a cohort of long-term non-progressors followed at the Aaron Diamond Aids Research Center, New York. Patients 3 and 8 were selected from a group of elite controllers that were followed at the Ragon Institute in Boston. Patients 1, 3 and 8 were selected based on their broad neutralizing serum activity against a standard panel of HIV isolates. Patient 12 was selected from the Protocol G Cohort of the "International Aids Vaccine Initiative" based on broad serum neutralizing activity.

Staining, Single-Cell sorting and antibody cloning. Staining and single cell sorting of 2CC-Core and gp140 specific Ig+ memory B cells was performed (J. F. Scheid et al., Nature 458, 636 (Apr. 2, 2009)). Briefly, CD19+B cells were enriched from peripheral blood mononuclear cells using anti human CD19 magnetic MACS beads (Miltenyi Biotec) and subsequently stained with anti human CD20 and anti human IgG antibodies (Becton Dickinson) as well as biotinylated 2CC-Core (B. Dey et al., PLoS Pathog 5, e1000445 (May, 2009)) or YU2-gp140 trimer (R. Diskin, P. M. Marcovecchio, P. J. Bjorkman, Nat Struct Mol Biol 17, 608 (May, 2010)) followed by detection with streptavidin coupled phycoerythrin (PE, Beckton Dickinson). Single cells were sorted on a FACSAria III cell sorter (Becton Dickinson), excluding cell doublets, into 96-well PCR plates (Denville) containing 4 µl/well of ice-cold 0.5× phosphate-buffered saline (PBS) containing 10 mM DTT, 8 U RNAsin® (Promega), 0.4 U 5'-3' Prime RNAse Inhibitor™ (Eppendorf). Plates were sealed with Microseal® 'F' Film (BioRad), immediately frozen on dry ice before storage at −80° C.

cDNA synthesis and Ig amplification were performed (H. Wardemann et al., Science 301, 1374 (Sep. 5, 2003)) with following modifications:

Instead of using the original primer sets, first and second immunoglobulin specific PCRs were carried out using the primers described in Table 1 in a semi-nested approach. Cloning of heavy and light chain PCR products into their respective expression vectors was performed and 100% identity of cloned expression plasmids with the original PCR product confirmed by sequencing before expression of the antibodies in HEK 293 cells.

ELISAs. High-binding 96-well ELISA plates (Costar) were coated overnight with 100 ng/well of purified antigens (gp140, gp120, gp41, gp120$^{core}$ and 2CC-core) (B. Dey et al., PLoS Pathog 5, e1000445 (May, 2009)) and mutant proteins (gp120 D368R, gp120 I420R) in PBS. After washing, plates were blocked 2 h with 2% BSA, 1 µM EDTA, 0.05% Tween-PBS (Blocking buffer) and then, incubated 2h with IgG antibodies diluted at 4 µg/ml and several consecutive 1:4 dilutions in PBS. After washing, the plates were developed by incubation for 1 h with goat HRP-conjugated anti-mouse IgG (Jackson ImmunoReseach) (at 0.8 µg/ml in blocking buffer) and by adding 100 µl of HRP chromogenic substrate (ABTS solution, Invitrogen). Optical densities were measured at 405 nm (OD$_{405\ nm}$) using an ELISA microplate reader (Molecular Devices). Background values given by incubation of PBS alone in coated wells were subtracted. IgG Antibodies were tested for polyreactivity (H. Mouquet et al., Nature 467, 591 (Sep. 30, 2010)) and considered polyreactive when they recognized at least two structurally different antigens out of the four tested; ssDNA, dsDNA, insulin, and LPS. Threshold values for reactivity were determined by using control antibodies mGO53 (negative), eiJB40 (low positive), and ED38 (high positive).

Neutralization assays: Neutralization screens were performed (D. C. Montefiori, Curr Protoc Immunol Chapter 12, Unit 12 11 (January, 2005)). In brief, neutralization was detected as reduction in luciferase reporter gene expression after single round infection in Tzm-b1 cells. In order to rule out unspecific antiviral activity in antibody samples MuLV (murine leukemia virus) was used as a negative control.

Clone specific identification of bone marrow plasma cells. Bone marrow plasma cells were stained with anti human CD138 and anti CD19 antibodies (Becton Dickinson) after Ficoll purification of mononuclear cells from bone marrow aspirates using Ficoll-Paque (GE Healthcare). CD138+ CD19+ human plasma cells were bulk sorted on a FACSAriaIII cell sorter (Becton Dickinson) and RNA isolation performed on 100.000 cells using Trizol LS reagent (Invitrogen) according to the manufacturers instructions. RNA was reverse transcribed using Superscript III reverse transcriptase (Invitrogen) according to manufacturers instructions. cDNA was then subjected to Immunoglobulin specific PCR with following modifications: 1 µl of cDNA was amplified in 2 rounds of nested immunoglobulin heavy chain clone specific PCR using first round forward leader and constant region reverse primers shown in Table 1 followed by clone specific forward and reverse primers designed based on sequencing results from single cell analysis. PCR products were gel purified and cloned into TOPO TA vectors (Invitrogen) according to the manufacturers instructions. Colonies were screened by PCR with clone specific primers and sequenced.

Figure 8B:
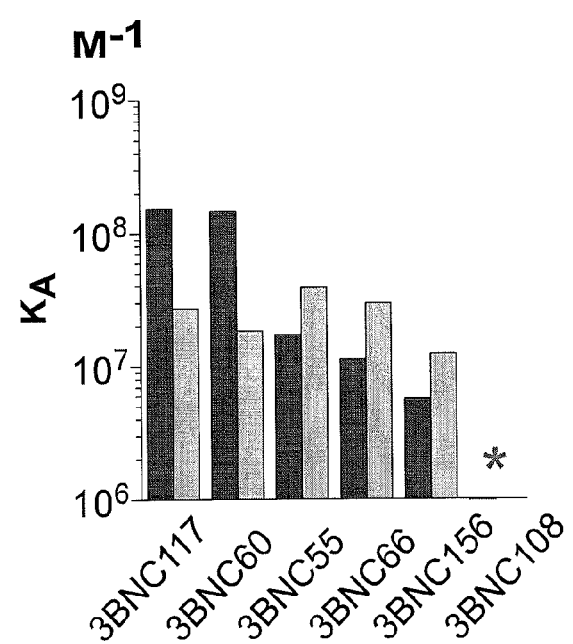
FIGS. 8A and B demonstrate affinity of HIV antibodies. (A) Antibody binding to gp140 and 2CC-core measured by surface plasmon resonance (SPR). The SPR sensograms for antibody binding of the selected 3BNC-antibody clones are shown over time. (B) Bar graphs show the binding affinity $(K_A)$ for gp140 and 2CC-core antigens for the selected IgG antibodies shown in A. RU, response units.

Surface plasmon resonance. All experiments were performed with a Biacore T100 (Biacore, Inc) in HBS-EP+ running buffer (Biacore, Inc) at 25° C. as described previously (Mouquet 2010). YU-2 gp140 and 2CC-core proteins at 12.5 µg/mL were immobilized on CM5 chips (Biacore, Inc.) by amine coupling at pH 4.5 resulting in an immobilization level of 100 RUs. For kinetic measurements on the gp140- and 2CC-core-derivatized chips, IgGs were injected through flow cells at 700 nM and 4 successive 1:2-dilutions in HBS-EP+ running buffer (Biacore, Inc.) at flow rates of 40 µL/min with 3 min association and 5 min dissociation. The sensor surface was regenerated between each experiment with a 30 second injection of 10 mM glycine-HCl pH 2.5 at a flow rate of 50 µL/min. Off rate ($k_d$ ($s^{-1}$)), on rate ($k_a$ ($M^{-1}\ s^{-1}$) and binding constants ($K_D$ (M) or $K_A$ ($M^{-1}$) were calculated after subtraction of backgrounds (binding to control flow cells and signal of the HBS-EP+ running buffer) using Biacore T100 Evaluation software using the kinetic analysis and the 1:1 binding model. The sensorgrams showed in FIG. 2 and FIG. 8 are derived from the Biacore data processing using Scrubber 2 sofware (Center for Biomolecular Interaction Analysis, University of Utah).

CD4i Site induction. 293T cells were transfected with gp160$^{BAL26}$Δc or gp160$^{YU.2}$Δc in a pMX-IRES-GFP construct (Pietzsch et al. 2010) using Fugene™6 (Roche) at a 1:2 plasmid:Fugene ratio. After 48 hours 293T cells were washed with PBS and detached with Trypsin-free cell dissociation buffer (Gibco) and resuspended at a concentration of $10^7$ cells/ml in FACS buffer (1×PBS, 2% FBS, 2 mM EDTA). sCD4 (Progenics Pharmaceuticals, Inc.) and mAbs were added to gp160-expressing 293T cells in a 1:4 dilution series starting with a final concentration of 40 µg/ml. mGO is a negative control antibody that does not bind to gp160Δc (H. Mouquet et al., Nature 467, 591 (Sep. 30, 2010)). After incubation for 15 min on ice cells were split and stained for 25 min on ice with an Alexa647-labeled CD4-induced site mAb (3-67; (J. F. Scheid et al., Nature 458, 636 (Apr. 2, 2009)) or an Alexa647-labeled control mAb (i.e. PG16; L. M. Walker et al., Science 326, 285 (Oct. 9, 2009)) or 2G12 for gp160$^{YU.2}$ and 2G12 for gp160$^{BAL.26}$). Antibody labeling was performed by using Alexa Fluor® 647 Microscale Protein Labeling Kit (Invitrogen). Cells were analyzed on an LSRFortessa cell analyzer (BD Bioscience).

Crystallization The 3BNC60 IgG was expressed by transient expression in HEK293-6E cells and prepared the Fab fragment was prepared by papain cleavage (R. Diskin, P. M. Marcovecchio, P. J. Bjorkman, Nat Struct Mol Biol 17, 608 (May, 2010). Crystallization screens were conducted at 20° C. by vapor diffusion in nL sitting drops using a Mosquito™ (TTP LabTech) crystallization robot on MRC crystallization plates (Jena Bioscience). We combined 3BNC60 Fab at a concentration of 9.5 mg/ml with reservoir solution in a 1:1 ratio to create 400 nL drops. Initial crystallization hits were obtained using the PEGRx HT™ (Hampton Research) crystallization screen and further optimized manually. Crystals suitable for data collection grew after several weeks in 11.7% polyethylene glycol 20,000, 0.1 M sodium acetate pH 5.0, 100 mM potassium/sodium tartrate, 20 mM lithium sulfate, 10 mM N-Cyclohexyl-2-aminoethanesulfonic acid (CHES) pH 9.5 in the monoclinic space group P2$_1$ with two Fabs in the asymmetric unit. Crystals were soaked in reservoir solution supplemented with 15% glycerol for 2 hours before immersing in reservoir solution supplemented with 30% glycerol and flash cooling in liquid nitrogen. Diffraction data were collected at the Stanford Synchrotron Radiation Lightsource (SSRL) beam-line 12-2 at 100 K using a Pilatus 6M detector. Data were indexed, integrated, and scaled using XDS W. Kabsch, *Acta Crystallogr D Biol Crystallogr* 66, 125 (February, 2010) (Table 8). Molecular replacement was conducted using Phaser with the V$_H$ and C$_H$1 domains from the anti-tumor antibody CTM01 (PDB code 1AD9) and with the V$_L$ and C$_L$ domains of the anti-gp120 b13 antibody (PDB code 3IDX) as search models. Model building and refinement to 2.65 Å resolution was done iteratively using Phenix P. Emsley, B. Lohkamp, W. G. Scott, K. Cowtan, Acta Crystallogr D Biol Crystallogr 66, 486 (April, 2010) and Coot (P. Emsley, B. Lohkamp, W. G. Scott, K. Cowtan, Acta Crystallogr D Biol Crystallogr 66, 486 (April, 2010)). The structure was refined using a maximum-likelihood target function and non-crystallographic symmetry restraints. The final model ($R_{work}$=20.7%; $R_{free}$=25.7%) includes 6478 protein atoms, 146 water molecules and 28 sugar atoms (Table 8). 91.9%, 7.6% and 0.5% of the residues were in the favored, allowed, and disallowed regions, respectively, of the Ramachandran plot. Structural analyses and visualization were done using PyMol (The PyMOL Molecular Graphics System, Version 1.3, Schrodinger, LLC). The 3BNC60 structure consists of residues 3-205 for the light chain (including the first N-acetylglucosamine within an N-linked carbohydrate attached to Asn72) and 2-217 for the heavy-chain. Residues at the termini residues and residues 133-140 within the C$_H$1 domain are disordered.

Mass Spectrometry. IgG was purified from serum using ProteinG Sepharose (GE Healthcare) according to the manufacturers instructions. IgGs were then digested with immobilized papain (Pierce) and digested Fab-Fc fragment mixes incubated with saturating quantities of biotinylated 2CC-Core protein. Streptavidin coupled Dynabeads (Invitrogen) were added after incubation for 15 minutes at room temperature and subjected to 10 rounds of washing with Phosphate Buffered Saline (Gibco). Bound Fab fragments were eluted with lithium dodecyl sulfate buffer (Invitrogen) at 95 C and sample purity confirmed with SDS-polyacrylamide gel electrophoresis followed by silver stain or coomassie staining before analysis by mass spectrometry.

Isolated Fab fragments were reduced with dithiothreitol, alkylated using iodoacetamide, resolved by 1D gel electrophoresis on a 4-12% NuPAGE Novex Bis-Tris gel (Invitrogen), and stained with Coomassie Blue (Thermo Fisher). The Fab fragments were excised from the gel, and digested using 200 ng of trypsin (Promega). The resulting peptides were isolated using reverse phase resin (PORS 20 R2, Applied Biosystem) and eluted using an aliquot of 40% acetonitrile in 0.5% acetic acid and a second aliquot of 80% acetonitrile in 0.5% acetic acid. Acetonitrile was removed using a speedvac (Thermo Fisher Scientific) and aliquots of the remaining solution pressure loaded onto self-packed PicoFrit® column (New Objective, Woburn, Mass.) with integrated emitter tip (360 µm O.D., 50 µm I.D., 10 µm tip), packed with 6 cm of reverse-phase C18 material (ReproSil-Pur C18-AQ, 3 µm beads from Dr. Maisch GmbH) and interfaced to a Agilent 1200 series HPLC system (Agilent) with either a LTQ Orbitrap™ XL mass spectrometer or a LTQ Orbitrap Velos™ mass spectrometer (Thermo Fisher Scientific) using a home-built micro electrospray source. The peptides were eluted into the mass spectrometer with the following gradient: 0 to 5% B in 5 min, 40% B in 125 min, 60% B in 150 min, 100% B in 165 min (A=0.1 M acetic acid, B=70% acetonitrile in 0.1 M acetic acid, flow rate 90 nL/min). Both instruments were operated in the data dependent mode and for both mass spectrometers the target value was set to 5e5 ions and a resolution of 60,000 (at 400 m/z). For analysis on the LTQ Orbitrap™ XL a full scan was followed by 8 MS/MS scans on the 8 most abundant ions from that full scan. The peptides (only charge states>1) were isolated with a 2 Da window, target window of 1e4 ions, dissociated via CAD (normalized collision energy=35, activation Q=0.25, activation time 30 msec) and mass analyzed in the LTQ. For analysis on the LTQ Orbitrap™ Velos a full scan was followed by 10 MS/MS scans at 7,500 resolution on the 10 most abundant ions from the immediate preceding full scan. The peptides (only charge state>2) were isolated with a 3 Da window, target window of 2e5 ions, dissociated via HCD (normalized collision energy=40, activation time 0.100 msec) and mass analyzed in the Orbitrap. For either instrument the ions selected for MS/MS were set on an exclusion list for 30 seconds. The resulting MS/MS spectra were searched against the Human IPI and in-house patient specific IgG database using Xtandem!, peptides were automatically compared to tryptic peptides in the human IPI and our in-house patient specific database. Peptide hits corresponding to patient specific IgG were manually confirmed.

Multiple sequence alignments. All multiple sequence alignments were conducted using CLUSTALW2 with default parameters (weight matrix: GONNET for proteins and UIB for DNA, gap open=10, gap extension 0.1). Alignments shading were generated using TeXshade package.

Alignment consensus. The consensus sequences for multiple alignments were generated based on identity and similarity between residues (>=70%). The amino acids were grouping due similarity as: FYW, ILVM, RK, DE, GA, ST and NQ.

Phylogenetic Germline Trees. The relationship between sequences was generated using the Neighbor-Joining method. The bootstrap consensus tree inferred from 1000 replicates was taken to represent the relationship. Branches corresponding to partitions reproduced in less than 50% bootstrap replicates are collapsed. The percentage of replicate trees in which the associated sequence clustered together in the bootstrap test (1000 replicates) are shown next to the branches. The tree is drawn to scale, with branch lengths in the same units as those of the evolutionary distances used to infer the phylogenetic tree. The evolutionary distances were computed using the number of differences method and are in the units of the number of amino acid differences per sequence. All ambiguous positions were removed for each sequence pair. Evolutionary analyses were conducted in MEGA5.

R/S Ratio Calculation. DNA sequences were superposed over the proteins alignments to replacement/substitution calculation. All gaps positions were removed from the analysis. The R/S ratio analysis was conducted using Perl scripts.

Example 2

Isolating HIV Antibodies

To determine whether HIV antibody cloning is limited because of somatic mutation, a new series of primers was designed to avert this potential problem (Table 1). The new primer set was tested by sorting B cells that bind to an HIV-gp120 core protein lacking the V1-3 loops and containing a pair of stabilizing disulfide bonds (2CC-core). In contrast to the re-surfaced bait used to clone VRC01, the 2CC-core bait also allows capture of antibodies to the CD4-induced co-receptor binding site (CD4i).

Figure 4B:
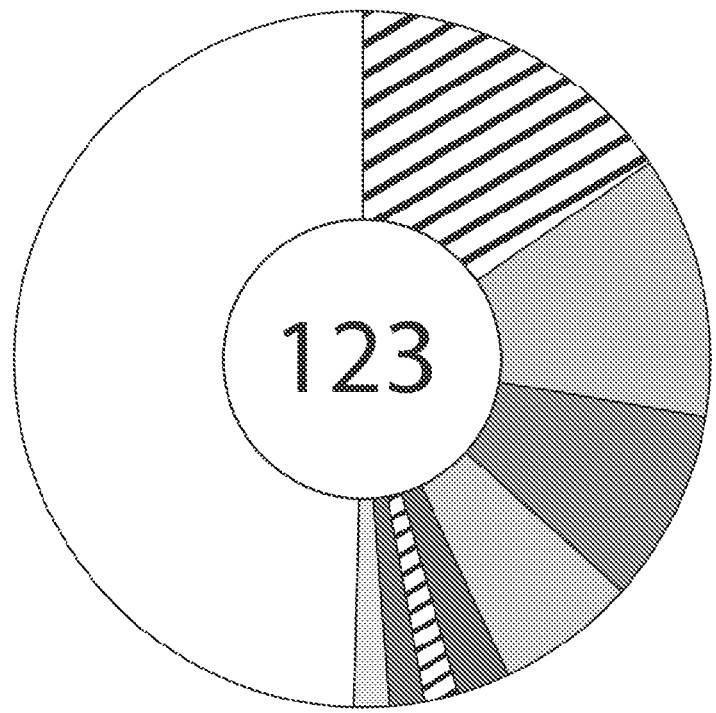
FIG. 4A and B show recovery of highly mutated immunoglobulin heavy chains with specific primers. (A) side by side comparison of new and old primer set. Red boxes indicate successful amplification of $IgV_H$ genes.

In side-by-side comparisons, the new primer set increased recovery of IgH chains when compared to the initial primer set (FIG. 4(a)). The antibodies obtained with the new primer set were more mutated (average 35.6 vs. 19.8 p=<0.0001 and maximum 85 vs. 50 for IgH) and included clones that were not found with the original primer set (FIG. 4(a)). To determine whether the new primers rescue VRC01-like antibodies from cells that had been sorted with YU2 gp140, frozen cDNA samples from that individual which had already been examined exhaustively with the original primer set without producing any VRC01 related clones were examined. In 80 wells, 3 antibodies corresponding to VRC01 variants as determined by the IgH and IgL sequences were found (FIGS. 5A and B). It was concluded that VRC01-like antibodies were captured by the gp140 trimer, and that primers that were specifically designed to clone highly mutated antibodies captured a larger fraction of anti-HIV antibodies from the memory B cells of patients with high titers of broadly neutralizing antibodies.

Four unrelated HIV infected individuals, including 2 Caucasians, 1 Hispanic and 1 African donor, showing high titers of broadly neutralizing antibodies were examined using the 2CC-core bait, including 2 individuals whose previously cloned antibodies could not account for their serologic activity (Table 2 and FIGS. 6A and B). 576 antibodies representing 201 different unique and diversified clones were obtained from a starting population of $1.5 \times 10^5$ IgG$^+$ memory B cells (Table 3).

Example 3

Binding Specificity of HIV Antibodies

The size of the antibody clones captured by 2CC-core bait differed widely ranging from 2-76 diversified members (Table 3). To determine whether the antibodies captured by the 2CC-core bind to the HIV spike, ELISAs were performed using YU2 gp120 on representative members of each expanded clone. All of the antibodies tested bound to gp120 (Table 3).

The site of antibody binding on the HIV spike was mapped using mutant proteins that interfere with either the CD4bs (gp120(D368R)), or the CD4-induced co-receptor binding site (CD4i, gp120(I420R)). As reported, X. Wu et al., Science 329, 856 (Aug. 13, 2010), VRC01 is classified as a CD4bs antibody since it is sensitive to the D368R mutation, but because of the proximity of the CD4i site, it also shows some sensitivity to the I420R mutation. NIH45-46, which is a VRC01 variant, and antibodies 3BNC60, 8ANC131, and 12A12 showed ELISA patterns that were similar to VRC01 (These clonal members were selected based on neutralizing activity, Table 3). Other clones, including 1B2530, and 8ANC195, were equally sensitive to both mutations and could not be classified precisely based solely on ELISA.

To determine whether the antibodies are polyreactive, ELISAs were performed on purified ssDNA, dsDNA, insulin, and LPS. 63% of the anti-2CC Core antibodies tested were polyreactive. It was concluded that the majority of the antibodies captured by the 2CC-bait recognize either the CD4bs or the CD4i site on gp120 and many are also polyreactive.

Example 4

Somatic Hypermutation

Somatic hypermutation is required for development of high affinity antigen binding and in some cases contributes to polyreactivity of anti-HIV antibodies. To test if this is the case for highly mutated 2CC-core specific antibodies, 4 representative antibodies were reverted to the corresponding germline. Reversion led to complete loss of antigen binding in ELISA for all 4 clones tested and to loss of polyreactivity.

Example 5

HIV Neutralization

Figure 6B:
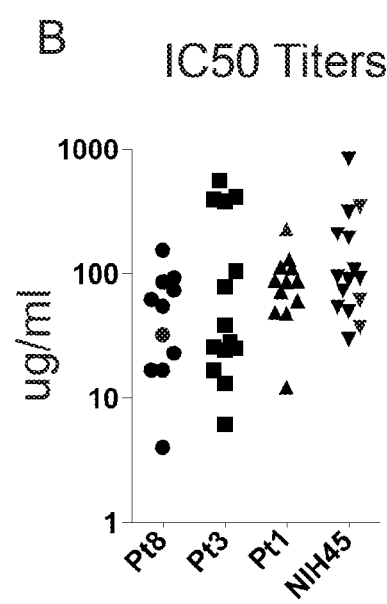
FIG. 6 shows patient serum neutralizing activity. (A) Table summarizes purified serum IgG neutralizing activity against a panel of Tier 2 viruses in a Tzm-b1 assay. Dark red boxes indicate $IC_{50}$ values below 10 µg/ml, orange between 10 and 100 µg/ml and yellow above 100 µg/ml. (B) dot plot summarizes the $IC_{50}$ values shown in A for the 4 more extensively tested patients.
Figure 7A:
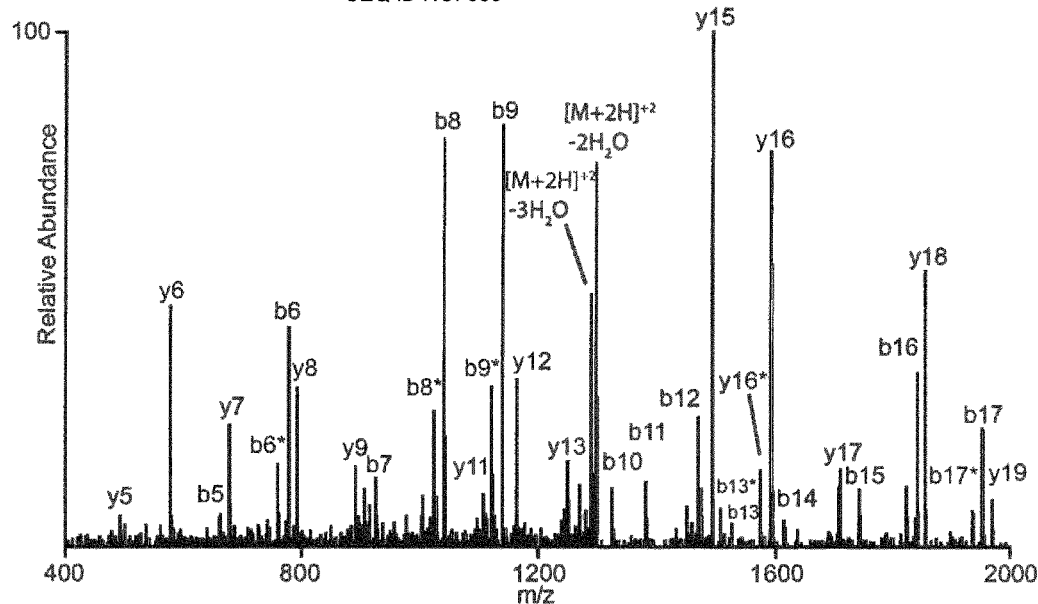
FIG. 7 demonstrates detection of antibodies by mass spectrometry. Collision activated dissociation MS/MS spectrum recorded on the doubly charged peptides HSDYCDFDVWGSGSQVIVSSASTK (SEQ ID NO: 888) from 3BNC153HC (A) and DGLGEVAPAYLYGIDAWGQGTTVIVTSASTK (SEQ ID NO: 889) from 8ANC134HC. (B. Observed b-type fragment ions (containing the N-terminus) and y-type fragment ions (containing the C-terminus) are labeled in the spectrum. Loss of water from fragment ions is indicated by *. Ions corresponding to the loss of water from the parent ion are labeled in the spectrum. Observed backbone cleavages are indicated in the sequence with ] for b-type ions and ⌋ for y type ions.
Figure 7B:
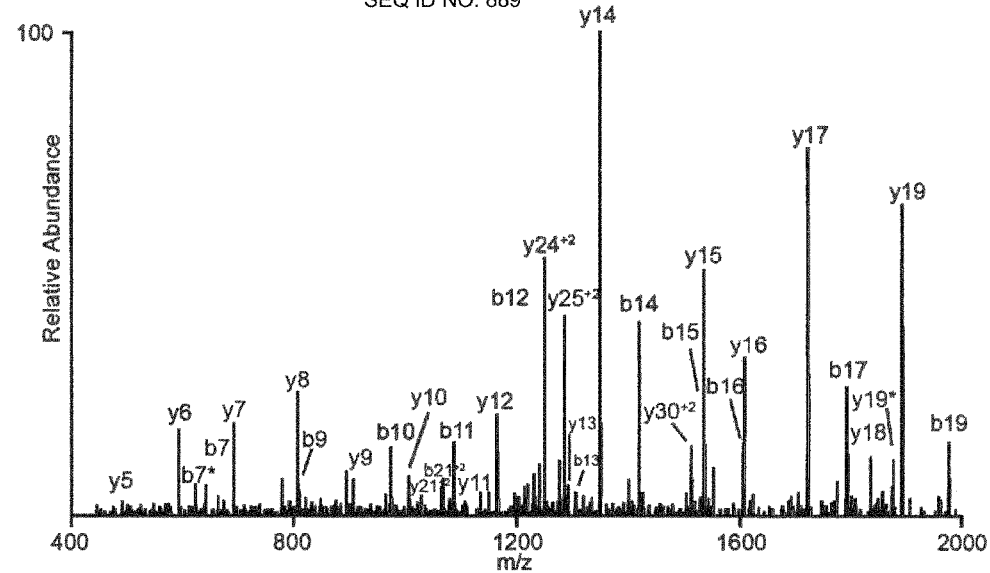

HIV neutralizing activity was measured in standardized in vitro assays using an initial panel of 8 viruses including 3 tier 1 Clade A, B and C, and 5 tier 2 Clade B Env pseudovirus variants (M. S. Seaman et al., J Virol 84, 1439 (February, 2010)). The neutralizing activity of the antibodies was compared to VRC01 and purified serum IgG from the donors (FIG. 1A, Table 4 and FIG. 6). Antibodies showing high levels of neutralizing activity were further tested on a panel of 15 additional tier 2 Clade A, B, C, D, G, AG and AE Env pseudovirus variants (FIG. 1B, Table 5) including 5 viruses that are resistant to VRC01 (FIG. 1B and Table 5).

90% of all of the antibodies tested showed some neutralizing activity and 6 clones contained antibody variants that showed high levels of potency and breadth (FIGS. 1A, B and C and Tables 4 and 5). These clones were also the most abundant among those captured by the 2CC-bait in each of the four patients studied (Table 3). The most impressive of the new antibodies, 3BNC117 belonging to a clone with 76 members, showed an average $IC_{80}$ on a combined group of 14 tier 2 viruses of 0.5 µg/ml as compared to 1.8 µg/ml for VRC01 (FIG. 1C, Tables 4 and 5).

Only 4 of the 20 viruses tested were more sensitive to VRC01 than 3BNC117, whereas 14 were more sensitive to 3BNC117 including DU172.17 which is completely resistant to VRC01 but sensitive to 3BNC117 (FIGS. 1B and C).

NIH45-46, a new variant of VRC01, is more potent than VRC01 on 15 of the 20 viruses tested but still less potent than 3BNC117 (FIGS. 1B and C and Tables 4, and 5).

There was substantial variation in neutralizing breadth and potency among the members of the 5 most potent neutralizing antibody clones. For example, 3BNC156, a variant of 3BNC117, neutralized only 2 of the viruses in the initial panel and at much higher concentrations than 3BNC117 (FIG. 1A and Table 4) and 3BNC55, another variant, was intermediate between the two showing activity against 6 viruses at an average $IC_{50}$ of 4 µg/ml (FIG. 1 and Table 4). Finally, the most active antibodies were highly hypermutated. The average number of mutations for the top 10 antibodies was 72 for $V_H$ and 45 for $V_L$, and this was associated with their breadth and potency (Tables 4 and 5). Reversion of the mutated residues to germline resulted in a complete loss of neutralizing activity for all of the antibodies tested.

Example 6

Identification of Diagnostic Peptides

The foregoing cloning strategy captured antibodies produced by antigen binding memory B cells, but circulating antibodies are not produced by these cells, and originate instead from plasma cells in the bone marrow. However, cognate antigen cannot be used as bait to capture plasma cells because they do not express surface Ig A. (Radbruch et al., Nat Rev Immunol 6, 741 (October, 2006)). In addition, the relationship between plasma cells in the bone marrow and circulating memory B cells is not defined precisely. To determine whether the antibodies cloned from memory B cells are also found in the bone marrow plasma cell compartment, CD138-expressing plasma cells were purified from paired bone marrow samples from 2 of the 4 individuals studied and used PCR to specifically amplify $IgV_H$ genes for the more potent antibodies cloned from memory B cells in these individuals. The following were the clone specific primers for RU01:

```
(FWRD)
                                          (SEQ ID NO. 584)
CTGCAACCGGTGTACATTCTCAAGTGCAACTGGTGC, (FWRD)
                                          (SEQ ID NO. 585)
CTGCAACCGGTGTACATTCTCAGGTCCATTTGTCACAG, (REV)
                                          (SEQ ID NO. 586)
TGCGAAGTCGACGCTGACGAGACAGTGACCTGC, (REV)
                                          (SEQ ID NO. 587)
TGCGAAGTCGACGCTGAAGAGACAATAATTTG, (REV)
                                          (SEQ ID NO. 588)
TGCGAAGTCGACGCTGACGAGACAATAACT
and for RU10:

(FWRD)
                                          (SEQ ID NO. 589)
CTGCAACCGGTGTACATTTTCAGGGGCACTTGGTG, (REV)
                                          (SEQ ID NO. 590)
TGCGAAGTCGACGCTGAGGTGACGATGACCGTG.
```

Members of the selected clones and large numbers of additional variants were readily identified in both patients.

To verify that these antibodies can also be found in serum, IgG purified from the serum of the same 2 and one additional individual were adsorbed on the 2CC-core bait and mass spectrometry was performed on the eluted IgG (FIG. 1D, FIG. 7 and FIGS. 10A-C). Diagnostic peptides were found for the highly active antibody variants in all cases (FIG. 7, FIG. 10A-C). It was concluded that broad and potent anti-HIV antibodies cloned from memory B cells were also found in the bone marrow plasma cell compartment, and in the circulating IgGs of patients with high serum titers of broadly neutralizing antibodies.

Example 7

HIV Antibody Binding Characteristics

To determine whether antibody affinity to gp120 is related to neutralizing activity, the binding of the highly active antibodies, selected clonal relatives and germline reverted progenitors were compared using Surface Plasmon Resonance (SPR) (FIGS. 2A and B, FIG. 8 and Table 6).

The top neutralizing antibodies showed affinities ($K_A$) ranging from ≅$10^7$-$10^{12}$ ($M^{-1}$) on YU2 gp140 trimers and ≅$10^7$-$10^{11}$ ($M^{-1}$) on the 2CC-core (FIGS. 2A and B and Table 6). Consistent with their decreased neutralizing potency and breadth, 3BNC66, 3BNC156 and 3BNC55 displayed lower affinities on YU2 gp140 trimers than 3BNC117, but surprisingly, affinities to 2CC-core did not correlate with neutralizing activity (FIG. 1, FIG. 8, Table 4 and Table 6). Binding by SPR was not detected for any of the germline reverted antibodies tested (FIG. 2B, Table 6). It was concluded that the anti-HIV antibodies captured by the YU2 2CC-core tended to show higher affinity to the corresponding gp140 trimer than to the 2CC-core.

When VRC01 binds to the HIV spike it produces large conformational changes that mimic CD4 binding and expose the CD4i site. By contrast, b12 and most other known anti-CD4bs antibodies do not.

To determine whether this is a shared feature of the highly active antibodies, HIV-BAL.26Δc or -YU2 gp160Δc was expressed on the surface of HEK 293T cells and CD4i antibody binding measured in the presence or absence of CD4 or anti-CD4bs antibodies (FIG. 2C). With one exception, all of the highly active antibodies tested resembled CD4 and VRC01 in that they facilitated anti-CD4i antibody binding to either HIV-BAL.26 or YU2 gp160Δc or both (FIG. 2C).

The only highly active antibody that did not share this characteristic, 8ANC195, was not a traditional anti-CD4bs antibody in that it was equally sensitive to the D368R and I420R mutations (Table 3). In addition, it differed from the other highly active antibodies in its neutralization pattern: it did not neutralize any of the tier 1 viruses and showed potent activity against H086.8, a Glade B virus resistant to all other antibodies tested including 3BNC117, VRC01 and b12 (FIGS. 1 A and B and Tables 4 and 5).

Example 8

HIV Antibody Sequence Identity

To determine whether highly active anti-CD4bs antibodies share common sequence features, the 10 best antibodies: 2 variants each from 5 independently derived antibody clones from 5 different patients were aligned (FIG. 3). Comparison of the $IgV_H$ regions revealed a highly conserved consensus sequence covering 68 $IgV_H$ residues (FIG. 3A). The $IgV_H$ consensus included 6 of VRC01-gp120 contact residues, including VRC01-Arg 71, which mimics the key interaction of $Arg59_{CD4}$ and $Asp368_{gp120}$ (FIG. 3A). More-over, the consensus, including the 6 contact residues, was entirely conserved in both of the closely related germline IgV$_H$ genes (V$_H$1-2 and V$_H$1-46) that give rise to all of the antibodies in this class (FIGS. 3A and B).

The codons encoding the consensus residues were highly somatically mutated in the 10 selected antibodies, nevertheless the amino acid sequence was conserved (FIG. 9). The ratio of replacement to silent mutations in the consensus residues ranged from 0.7-1.7, whereas it was 3.5-22 in the non-consensus residues indicating that conservation of the consensus is strongly selected (Table 7). In contrast to the heavy chain, the light chain of VRC01 made only 8 out of a total of 32 contacts with gp120. Consistent with its more limited role, comparison of the light chain sequences of the same antibodies uncovered a less extensive consensus covering 53 IgV$_L$ residues including 3 VRC01-gp120 contact residues (FIG. 3B). Finally, like the heavy chains, the light chains arose from a limited set of germline genes: 2 were derived from IgK1D-33, 2 from IgK3-11, and one from IgL1-47 (FIG. 3B and Table 3). Antibody 8ANC195, which differed from the others in several important respects did not entirely conform to the consensus and did not arise from related heavy or light chains (FIGS. 3A and B) It was concluded that there is significant sequence convergence among highly active agonistic anti-CD4bs antibodies (HAADs).

Example 9

Crystal Structure of 3BNC60 Fab

To determine whether the structure of the antibodies in different patients is also conserved, the crystal structure of the 3BNC60 Fab was solved to 2.65 Å resolution and compared it to VRC01. The structure revealed the four domains, V$_H$, C$_H$1, V$_L$, and C$_L$, of a canonical Fab and the complementarity-determining regions (CDRs) within V$_H$ and V$_L$ that form the antigen binding site. The two Fabs in the 3BNC60 asymmetric unit were almost identical; however, the conformation of residues 74-78 in the loop connecting strands D and E varied slightly due to different chemical environments formed by crystal lattice contacts.

Superimposition of the V$_H$ domains from 3BNC60 and VRC01 in the VRC01-gp120 co-crystal structure (T. Zhou et al., Science 329, 811 (Aug. 13, 2010)) yielded a root mean square deviation (rmsd) of 1.3 Å (calculated for 111 Cα atoms) with major differences confined to CDR2 residues 58-65 (3BNC60 numbering). Superimposing the structures indicated conservation of the recognition interface with gp120. For example, Arg72$_{3BNC60}$ adopted a similar conformation as Arg71$_{VRC01}$, which mimics an important salt bridge normally formed between Arg59$_{CD4}$ and Asp368$_{gp120}$. In addition, Trp47$_{3BNC60}$ adopted the same conformation as Trp47$_{VRC01}$, a residue that contacts gp120 and is involved with a complex network of interactions of aromatic and aliphatic residues that stabilize the conformations of CDRH3 and CDRL3. Gln65$_{3BNC60}$, which corresponds to Gln64$_{VRC01}$, is within the residue segment (residues 58-65) that differs in structure from VRC01. The conformation of this region of 3BNC60, which is involved in a lattice contact in the crystals, is likely to change upon binding gp120, as it would clash with the CD4-binding loop on gp120.

Superimposing the 3BNC60 and VRC01 V$_L$ domains yielded an rmsd of 0.9 Å (calculated for 95 Cα atoms) and showed that some of gp120-contacting residues are structurally conserved; Tyr91$_{3BNC60}$ and Glu91a$_{3BNC60}$ adopted similar conformations as Tyr91$_{VRC01}$ and Glu96$_{VRC01}$, which engaged loop D of gp 120 via polar interactions. Overall, these structural comparisons suggested that 3BNC60 binds gp120 with the same architecture as observed for the binding of VRC01.

Example 10

HIV Antibody Consensus Sequence

The foregoing experiments defined a class of agonistic anti-CD4bs antibodies, HAADs, that shares IgV$_H$ and IgV$_L$ consensus sequences including 8 of the contact residues between VRC01 and the HIV spike (FIGS. 3A and B). In five different donors, selected for their high level serologic anti-HIV activity, these antibodies originated from only 2 closely related $IgV_H$ and 3 $IgV_L$ germline genes that conform to the HAAD consensus: $V_H$1-2 and $V_H$1-46 differ by only 7 amino acids, none of which are part of the consensus (FIG. 3A). Despite extensive somatic hypermutation, the consensus residues were retained in their germline form.

The only exception to the consensus, 8ANC195, differed from the others in a number of ways that suggest that it may have a unique mode of antigen recognition: absence of the Arg in the heavy chain that mimics the critical $Arg59_{CD4}$ and $Asp368_{gp120}$ contact site; unique neutralizing pattern; and inability to facilitate anti-CD4i antibody binding. This antibody is one of two distinct highly active antibodies arising in one patient, lending additional support to the idea that serologic neutralizing activity is combinatorial.

TABLE A

| Seq ID No. | Antibody | Heavy Chain Amino Acid Sequence |
|---|---|---|
| 5 | 8A253HC | QGQLVQSGGGLKKPGTSVTISCLASEYTFNEFVIHWIRQAPGQGP LWLGLIKRSGRLMTAYNFQDRLSLRRDRSTGTVFMELRGLRPDDT AVYYCARDGLGEVAPDYRYGIDVWGQGSTVIVTAASTKG |
| 6 | 8A275HC | QGLLVQSGGGVKKLGTSVTISCLASEYTFNEFVIHWIRQAPGQGPL WLGLIKRSGRLMTSYQFQDRLSLRRDRSTGTVFMELRGLRVDDT AVYYCARDGLGEVAPAYLYGIDAWGQGTTVIVTSASTKG |
| 7 | 8ABM11 | FQGHLVQSGGGVKKPGTSVTLSCLASEYTFTEFTIHWIRQAPGQG PLWLGLIKRSGRLMTSYRFQDRLSLRRDRSTGTVFMELRSLRTDD TAVYYCARDGLGELAPAYHYGIDAWGQGTTVIVTSASTS |
| 8 | 8ABM12 | QGHLVQSGGGVKKLGTSVTISCLASEYTFNEFVIHWIRQAPGQGP LWLGLIKRSGRLMTSYQFQDRLSLRRDRSTGTVFMELRGLRVDDT AVYYCARDGLGEVAPAYLYGIDAWGQGTTVIVTSAST |

TABLE A-continued

| Seq ID No. | Antibody | Heavy Chain Amino Acid Sequence |
|---|---|---|
| 9 | 8ABM13 | QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS |
| 10 | 8ABM14 | GHLVQSGGGXKKPGTSVTISCLASEYTFTEFTIHRIRQAPGQGPLWLGLIKGSGRLMTSYGFQDRLSLRRDRSTGTVFMELRSLRTDDTAVYYCARDGLGELAPAYHYGIDVWGQGTTVIVTSASTS |
| 11 | 8ABM20 | GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGTTVIVTSASTS |
| 12 | 8ABM24 | FQGQLVQSGGGVKKPGSSVTISCLASEYTFTEFTIHWIRQAPGQGPLWLGLIKRSGRLMTSYQFQDRLSVRRDRSTGTVFMELRSLRTDDTAVYYCARDGLGELAPAYHYGIDVWGQGTTVIVTSASTS |
| 13 | 8ABM26 | QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS |
| 14 | 8ABM27 | QGHLVQSGXEVKKPGSSVKVSCKASGGTFSXYAIGWVRQAPGQGLEWMGGIIPILGTTNYAQRFQGGVTITADESTNTAYMDVSSLRSDDTAVYYCAKAPYRPRGSGNYYYAMDVWGQGTTVIVSSASTS |
| 15 | 8ANC105HC | QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG |
| 16 | 8ANC116HC | QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG |
| 17 | 8ANC127HC | QGHLVQSGGGVKKLGTSVTISCLVSEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG |
| 18 | 8ANC131HC | QGQLVQSGGGLKKPGTSVTISCLASEYTFNEFVIHWIRQAPGQGPLWLGLIKRSGRLMTAYNFQDRLRLRRDRSTGTVFMELRGLRPDDTAVYYCARDGLGEVAPDYRYGIDVWGQGSTVIVTAASTKG |
| 19 | 8ANC134HC | QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSTVIVTSASTKG |
| 20 | 8ANC13HC | QGQLVQSGGGVKKPGASVTISCLASEYTFNEFVIHWIRQAPGQGPLWLGLIKRSGRLMTAYKFQDRLSLRRDRSTGTVFMELRGLRPEDTAVYYCARDGLGEVAPDYRYGIDVWGQGSTVIVSAASTKG |
| 21 | 8ANC171HC | QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG |
| 22 | 8ANC18 | GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGSTVIVTSASTS |
| 23 | 8ANC182HC | QGQLVQSGGGVKKPGTSVTISCLASEYTFTEFTIHWIRQAPGQGPLWLGLIKRSGRLMTAYRFQDRLSLRRDRSTGTVFMELRNLRMDDTAVYYCARDGLGELAPAYQYGIDVWGQGTTVIVSSASTKG |
| 24 | 8ANC192HC | QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG |
| 25 | 8ANC22HC | QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG |
| 26 | 8ANC26HC | QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSKVIVTPASTKG |
| 27 | 8ANC2HC | QGQLVQSGGGVKKLGTSVTIPCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG |

TABLE A-continued

| Seq ID No. | Antibody | Heavy Chain Amino Acid Sequence |
|---|---|---|
| 28 | 8ANC30HC | QGQLVQSGGGVKKLGTSVTISCLASEYTFNEFVIHWIRQAPGQGPLWLGLIKRSGRLMTSYQFDRLSLRRDRSTGTVFMELRGLRVDDTAVYYCARDGLGEVAPAYLYGIDAWGQGTTVIVTSASTKG |
| 29 | 8ANC37HC | QGHLVQSGGGVKKLGTSVTISCLASEYTFNEFVIHWIRQAPGQGPLWLGLIKRSGRLMTSYQFDRLSLRRDRSTGTVFMELRGLRVDDTAVYYCARDGLGEVAPAYLYGIDAWGQGTTVIVTSASTKG |
| 30 | 8ANC40HC | QGHLVQSGGGVKKLGTSVTISCLASEYTFNEFVIHWIRQAPGQGPLWLGLIKRSGRLMTSYQFDRLSLRRDRSTGTVFMELRGLRVDDTAVYYCARDGLGEVAPAYLYGIDAWGQGTTVIVTSASTKG |
| 31 | 8ANC41HC | QGQLVQSGGGVKKTGTSVTISCLASEYTFTEFTIHWIRQAPGQGPLWLGLIKRSGRLMTANRFQDRLSLRRDRSTGTVFMELRSLRIDDTAVYYCARDGLGELAPAYHYGIDVWGQGTTIIVTSASTKG |
| 32 | 8ANC45HC | QGQLVQSGGGVKKTGTSVTISCLASEYTFTEFTIHWIRQAPGQGPLWLGLIKRSGRLMTANRFQDRLSLRRDRSTGTVFMELRSLRIDDTAVYYCARDGLGELAPAYHYGIDVWGQGTTIIVTSASTKG |
| 33 | 8ANC50HC | QGQLVQSGGGVKKPGTSVTISCLASEYTFTEFTIHWIRQAPGQGPLWLGLIKRSGRLMTAYRFQDRLSLRRDRSTGTVFMELRNLRMDDTAVYYCARDGLGELAPAYQYGIDVWGQGTTVIVSSASTKG |
| 34 | 8ANC53HC | QGQLVQSGGGGKKLGTSVTISCLASEYTFNEFVIHWIRQAPGQGPLWLGLIKRSGRLMTSYQFDRLSLRRDRSTGTVFMELRGLRVDDTAVYYCARDGLGEVAPAYLYGIDAWGQGTTVIVSSASTKG |
| 35 | 8ANC88HC | QGQLVQSGGGVKKPGTSVTISCLASEYTFNEFVIHWIRQAPGQGPLWLGLIKRSGRLMTSYKFQDRLNLRRDRSTGTVFMELRGLRPDDTAVYYCARDGLGEVAPDYRYGIDVWGQGSTVIVTAASTKG |
| 36 | 8ANC103HC | QVQLQQWGSGLLKPSETLSLTCAVYGGSFRSYYWNWIRQSPGKGLEWIGEVSHSGSTNYNPALKSRVTISVDTSKNQFSLKVKSVTAADTALYYCSRGRGKRCSGAYCFAGYFDSWGQGGLVVVSSASTKG |
| 37 | 8ANC106HC | EVQLVESGGGVVEPGESLRLSCAASGFTFRSYDMFWVRQATGKSLEWVSAIGIAGDTYYSGSVKGRFTISRENARTSLYLQLSGLRVEDSAVYFCVRGSPPRIAATEYNYYYGLDVWGQGTTVSVFSASTKG |
| 38 | 8ANC107HC | VVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG |
| 39 | 8ANC108HC | QVQLVQSGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG |
| 40 | 8ANC109HC | EVQLVESGGGLVKPGGSLRLSCAASGFSFSEHYMSWIRLAPGKGLEWLSYISSSTRTTYSADSVRGRFTISRDTAKQLLFLHMSSLRAEDTAVYYCVRLYGGINGWFDQWGQGTLVSVSSASTKG |
| 41 | 8ANC10HC | QVQLVQSGAEVKKPGSSVKVSCKTSGGSFSNYAFSWVRQAPGEGLEWMGRIIPIFGTAKYTQKLQGRVTITADKFTSTVYMELSSLRSEDTAIYYCASLHQGPIGYTPWHPPPRAPLGQSVCG |
| 42 | 8ANC111HC | QVQLVESGAEVKKPGASVKVSCKASGYTFTSHDINWVRQATGQGLEWMGWMNPNSGDTGYAHKFQGRVTMTRNTPISTAYMELSSLRSEDTAVYYCARGRATSRNTPWAHYYDSSGYYGAGDYWGQGTLVTVSSASTKG |
| 43 | 8ANC112HC | QVQLVESGGGVVQPGRSLRLFCAASGFAFNTYGMHWVRQAPGKGLEWVAVTWHDGSQKYYADSVKGRFTISRDNSKNTLYLQMNSLRAEDTAIYYCASDQGGFDDSSGYFAPGGMDVWGRGTTVIVSSAPTKG |
| 44 | 8ANC113HC | QVQLVESGAELRKPGESLEISCKASGYSFSSHWIGWARQMPGKGLEWMGIIYPGDSNTIYSPSFQGQVTISADKSINTAYLQWSSLKASDTAMYFCASNYHDYFWGQGTLVTVSSASTKG |
| 45 | 8ANC114HC | EVQLVESGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG |

TABLE A-continued

| Seq ID No. | Antibody | Heavy Chain Amino Acid Sequence |
|---|---|---|
| 46 | 8ANC115HC | QVQLVQSGAEVRKPGSSLKVSCKSSGGTFSRYVVNWVRQAPGQ GLEWMGGIIPIFGIAKYAQKFQDRVTMTADEPKNTVYLDFNSLRSD DTAVYYCARDRGDTRLLDYGDYEDERYYYGMDVWGQGTTVIVSS ASTKG |
| 47 | 8ANC117HC | EVQLVQSGAEVKKPGSSVKVSCKASGGTFSTYAFSWVRQAPGQ GLEWMGGIIPIFGTENYAQKFQGRVTITADKSTSTAYMELSSLRSE DTAVYYCARDRSSAIGYCSSISCYKGSFDIWGQGTMVTVSSASTKG |
| 48 | 8ANC11HC | QVFVQLVQSGGGLVQPGGSVRLSCTASGFLFSTYSMNWVRQAP GKGLEWVSSISTTSNYIYYADSVKGRFTISRSNGQGSLYLQLNSLR VEDTAVYYCARDTKVGAPRQDCYAMDLWGQRDHGHRLLSFHQG PIGLPPGALLQ |
| 49 | 8ANC121HC | QVQLLESGPGLVTPSGTLSLACAVSGASISSSHWWTWVRQSPGK GLEWIGEIDRRGTTNYNPSLRSRVTILLDNSKNQFSLSLRSVTAAD TAVYYCTKVYAGLFNERTYGMDVWGHGTTVLVSSASTKG |
| 50 | 8ANC126HC | QVQLVESGAEVRKPGSSLKVSCKSSGGTFSRYVVNWVRQAPGQ GLEWMGGIIPIFGIAKYAQKFQDRVTMTADESKNTVYLDFSSLRSD DTAVYYCARDRGDTRLLDYGDYEDERYYYGMDVWGQGTTVIVSS ASTKG |
| 51 | 8ANC130HC | QVQLLQSGAEVKKPGASVKVSCKVSGYTLTELSINWVRQAPGKGL EWMGGFDPEDDEAIYEPKFQGRLTMTEDTSTDTAYMELSSLRSE DTAVYYCATADPFKVAQDEGLYVIFDYWGQGTLVTVSSASTKG |
| 52 | 8ANC132HC | QVQLVQSGTEVQKPGASVKVSCKTSGYTFSKYYIHWVRQAPGQG LEWVGRINTDSGGTDYAEKFQGRVTMTRDTSITTVYLEMRGLTSD DTAAFYCARGPPHAGGWTIYYYGLDVWGQGTSVIVSSASTKG |
| 53 | 8ANC133HC | QVQLVQSGAEVKKPGASVKVSCKVSGHTLSELSINWVRHVPGKG LEWMGGLDPEDGEAIHEPKFQGRLTMTEDTSTDTAYVELSSLRSE DTAMYYCATADPFKVAQDEGLYVIFDYWGQGTLVTVSSASTKG |
| 54 | 8ANC136HC | EVQLVESGGGVVQPGRSLRLSCAASGFTFSHHGIHWVRQAPGEG LEWVAVISEDGTNIHYEDSVRGRFTISRDNSKNTVDLQMNSLRAE DTAVYYCASLISMRDGDAFDLWGQGTRVTVSSASTKG |
| 55 | 8ANC137HC | QVQLVQSGAEVRKPGSSLKVSCKSSGGTFSRYVVNWVRQAPGQ GLEWMGGIIPIFGIAKYAQKFQDRVTMTADESKNTVYLDFSSLRSD DTAVYYCARDRGDTRLLDYGDYEDERYYYGMDVWGQGTTVIVSS ASTKG |
| 56 | 8ANC139HC | QVQLVQSGGGLVKPGGSLRLSCAASGFTFSSYSMNWVRQAPGK GLEWVSSISSSSSYIYYADSVKGRFTISRDNAKNSLYLQMNSLRAE DTAVYYCAREGSYYYGMDVWGQGTTVTVSSASTKG |
| 57 | 8ANC140HC | EVQLVQSGGGLVQPGRSLRLSCAASGFTFDDYAMHWVRQAPGK GLEWVSGISWNSGTIGYADSVRGRFTISRDDAKSSLYLQMNSLRT EDTALYYCAKDGWVSGSSTLRGSDYWGQGTLVTVSSASTKG |
| 58 | 8ANC142HC | QIHLVQSGTDVKKPGSSVTVSCKAYGVNTFGLYAVNWVRQAPGQ SLEYIGQIWRWKSSASHHFRGRVLISAVDLTGSSPPISSLEIKNLTS DDTAVYFCTTTSTYDQWSGLHHDGVMAFSSRGQGTLISVSAAST KGPSVFPLAPSSKSTYGLAHVL |
| 59 | 8ANC143HC | QVQLVQSGAEVRKPGSSLKVSCKSSGGTFSRYVVNWVRQAPGQ GLEWMGGIIPIFGIAKYAQKFQDRVTMTADEPKNTVYLDFNSLRSD DTAVYYCARDRGDTRLLDYGDYEDERYYYGMDVWGQGTTVIVSS ASTKG |
| 60 | 8ANC144HC | QLQLQESGPGLVKPWETLVLTCSVSGGSISSGDYYWGWIRQSPG KGPEWIGNIFYSSGNTYYNTSLKSRVTISVDVSKNRFSLKLTSMTA ADTAVYYCGRLSNKGWFDPWGQGTLVSVSSASTKG |
| 61 | 8ANC145HC | QVQLLESGGGLVQRGGSLRLSCTASGFVFNNYWMTWVRQAPGN GLEWVANIDQDGSEKHYLDSVKGRFTISRDNAKNSLYLQMNSLRA EDTAIYYCARVRFKVTAWHRFDSWGQGDLVTVSSTSTKG |
| 62 | 8ANC146HC | LVQLLQSGAEVKKPGASVKVSCKVSGYTLTELSIHWVRQAPGKGL EWMGGFDPEDDEAIYEPKFQGRLTMTEDTSTDTAYMELSSLRSE DTAVYYCATADPFKVAQDEGLYVIFDYWGQGTLVTVSSASTKG |

TABLE A-continued

| Seq ID No. | Antibody | Heavy Chain Amino Acid Sequence |
|---|---|---|
| 63 | 8ANC147HC | QVQLVESGGGLGQPGGSLRLSCAASGFTFRNYAMSWVRQAAGK GLEWVSGVSGGGDTTYYGDSVKGRFTISRDNSKNTLYLQMNNLR AEDTAVYYCAKDKGVWGSSDFDYWGQGTLVTVSSASTKG |
| 64 | 8ANC148HC | QVHLVQSGAEVKKPGASVRVSCKASGYTFTTYGISWVRQAPGQG LEWMGWISAHSGDTNYAQKLQARVTMTTDTSTNTAYMELRSLTS DDTAVYYCARDRPRHYYDRGGYYSPFDYWGQGTLVTVSSASTKG |
| 65 | 8ANC149HC | QVQLVESGAEVKKPGSSVKVSCKASGGTFNIFAFSWVRQAPGQG LEWMGGIIPIFASPNYAQRFQGRVTITADESTSTVHMELSSLRSED TAIYYCAKDAHMHIEEPRDYDYIWGTSPYYFDYWGQGTLVTVSSA STKG |
| 66 | 8ANC14HC | QVQLVQSGAEVKKPGASVKVSCKVSGYTLTELSIHWVRQAPGKG LEWMGGFDSEDGEAFYKQNFQGRVTMTEDTSTDTAYMELRRLR SEDTAVYYCATADRFKVAQDEGLFVIFDYWGQGTLVTVSSASTKG |
| 67 | 8ANC150HC | QVQLLQSGGEVKKPGASVKVSCKVSGYTLTELSIHWVRQAPGKG LEWMGGFDPEDDEAIYEPKFQGRLTMTEDTSTDTAYMELSSLRSE DTAVYYCATADPFKVAQDEGLYVIFDYWGQGTLVTVSSASTKG |
| 68 | 8ANC151HC | EVQLVESGGGLVQPGGSLRLSCAASGFTFSSYSMNWVRQAPGK GLEWVSYISGSSYTIYYADSVRGRFTISRDNAKNSLYLQMNSLRDE DTAVYFCARATPPNPLNLYNYDSSGSSFDYWGQGTLVTVSSAST KG |
| 69 | 8ANC153HC | QVQLVQSGAEVRKPGSSLKVSCKSSGGTFSRYVVNWVRQAPGQ GLEWMGGMIPIFGIAKYAQKFQDRVTMTADESKNTVYLDFSSLRS DDTAVYYCARDRGDTRLLDYGDYEDERYYYGMDVWGQGTTVIVS SASTKG |
| 70 | 8ANC154HC | QVQLVESGAEVRKPGSSLKVSCKSSGGTFSRYVVNWVRQAPGQ GLEWMGGIIPIFGIAKYAQKFQDRVTMTADEPKNTVYLDFNSLRSD DTAVYYCARDRGDTRLLDYGDYEDERYYYGMDVWGQGTTVIVSS ASTKG |
| 71 | 8ANC155HC | QVQLVQSGAEIKKPGESLKISCKASGYTFNDYWIGWVRQMPGKG LEWMGIFYPDDSDSNYSPSFQGRVTISADKSITTAYLQWSTLKASD SAMYFCARLLGDSGAFDIWGQGTMVIVSSASTKG |
| 72 | 8ANC156HC | EVQLVESGAEVRKPGSSLKVSCKSSGGTFSRFVVNWVRQAPGQ GLEWMGGMIPIFGIAKYAQKFQDRVTMTADESKNTVYLDFSSLRS DDTAVYYCARDRGDTRLLDYGDYEDERYYYGMDVWGQGTTVIVS SASTKG |
| 73 | 8ANC157HC | QVQLVQSGAEVKKPGSSVKVSCKASGGTFSTYAFSWVRQAPGQ GLEWMGGIIPIFGTENYAQKFQGRVTITADKSTSTAYMELSSLRSE DTAVYYCARDRSSAIGYCSSISCYKGSFDIWGQGTMVTVSSASTKG |
| 74 | 8ANC158HC | QVQLVQSGAEVRKPGSSLKVSCKSSGGTFSRFVVNWVRQAPGQ GLEWMGGMIPIFGIAKYAQKFQDRVTMTADESKNTVYLDFSSLRS DDTAVYYCARDRGDTRLLDYGDYEDERYYYGMDVWGQGTTVIVS SASTKG |
| 75 | 8ANC160HC | QVQLVQSGGGVVQPGRSLRLSCAASGFTFSHHGIHWVRQAPGE GLEWVAVISEDGTNIHYEDSVRGRFTISRDNSKNTVDLQMNSLRA EDTAVYYCASLISMRDGDAFDLWGQGTRVTVSSASTKG |
| 76 | 8ANC161HC | EVQLVQSGGGLVKPGGSLRLSCAASGFTFKNAWMSWVRQAPGK GLEWVGHIKSKTDGGTIDYAAPVKGRFTISRDDSKNTLYLQMNSLK IEDTAVYYCTTDIGSGRGWDFHYYDSNDWGQGTLVTVSSASTKG |
| 77 | 8ANC162HC | EVQLVQSGGGVVQPGRSLRLSCVVSGFTFSSFTFHWVRQAPGK GLEWVAGMSFHATYIYYADSVKGRFTISRDDSQDTLYLEMDSLRS EDTAIYYCARDPGIHDYGDYAPGAFDYWGQGSPVTVSSASTKG |
| 78 | 8ANC163HC | LVQLVQSGAEVKKPGASVKVSCKVSGHTLSELSINWVRHVPGKGL EWMGGLDPEDGEAIHEPKFQGRLTMTEDTSTDTAYSTLSVWAPV AAAMYYCATADPFKVAQDEGLYVIFDYWGQGTLVTVSSASTKG |
| 79 | 8ANC164HC | EVQLVESGAEVKKPGSSVKVSCKASGGTFSSYSISWVRQAPGQG LEWMGGIIPIFATTHYGQKFQGRIKITADKSTSTAYMELSRLRSEDT AVYYCARDREFYFYGMDVWGQGTTVTVSSASTKG |

TABLE A-continued

| Seq ID No. | Antibody | Heavy Chain Amino Acid Sequence |
|---|---|---|
| 80 | 8ANC165HC | QVQLQQWGAGLLKPSETLSLTCAVYAGSFSGYYWTWIRQPPGKG LEWIGEVNHGGSTNYNPSLKSRVTLSVDTSKNQFSLKLTSVTAAD TAVYYCARVSRYDFWSGNYGSYGLDVWGQGTTVTVSSASTKG |
| 81 | 8ANC166HC | WQLVQSGAEVRKPGSSLKVSCKSSGGTFSRFVVNWVRQAPGQ GLEWMGGMIPIFGIAKYAQKFQDRVTMTADESKNTVYLDFSSLRS DDTAVYYCARDRGDTRLLDYGDYEDERYYYGMDVWGQGTTVIVS SASTKG |
| 82 | 8ANC168HC | LVQLVQSGAEVKKPGASVKVSCKVSGYSLTELSIHWVRQAPGKGL EWMGGFDSEDGEAIYKQNFQGRVTMTEDTSTDTAYMELSRLRSE DTAVYYCATADPFKVAQDEGLFVIFDYWGQGTTGHRLLSLHQGP HRLYSLGTLLSRAPIVQTHMA |
| 83 | 8ANC169HC | QVQLVQSGAEVKKPGSSVKVSCKASGGTFSTYAFSWVRQAPGQ GLEWMGGIIPIFGTENYAQKFQGRVTITADKSTSTAYMELSSLRSE DTAVYYCARDRSSAIGYCSSISCYKGSFDIWGQGTMVTVSSASTKG |
| 84 | 8ANC16HC | QVQLVQSGAEVKKPGSSVKVSCKASGGTFSTYAFSWVRQAPIEG LEWMGGIIPIFGTENYAQKFQGRVTITADKSTSTAYMELSSLRSED TAVYYCARDRSSAIGYCSSISCYKGSFDIWGQGTMVTVSSASTKG |
| 85 | 8ANC173HC | QVQLVQWGAGLLKPLETLSLTCAVYGGSFNGYFWSWIRQTPGKG LEWIGEINHGGSANFNPSLKSRVTMSVDTSKNQFSLKLASVTAAD TAIYYCARGRITMVRGDPQRGGVRMDVWGQGTSVTVSSASTKG |
| 86 | 8ANC174HC | QVQLMQSGAEVKRPGASVKVSCKAFRHSLNNLGISWIRRAPGRG LEWLGWINVYEGNTKYGRRFQGRVTMTTDRSTNTVSMELRSLTS DDTAVYYCARDNHFWSGSSRYYYFGMDVWGQGTTVIVSSASTKG |
| 87 | 8ANC175HC | QVQLVQSGGGLVQPGESLRLSCTASGFTFSSYNMNWVRQAPGK GLEWISYISDKSKNKYYADSVRGRFTISRDNAQNSLFLQMSSLRDE DTAVYYCTREGPQRSFYFDYWGQGIQVTVSSASTKG |
| 88 | 8ANC176HC | QVQLQESGPGLVKPSETLSLTCTVSGGSISNHYWSWIRQPPGKGL EWIGYIYHSGNINYKSSLKSRATISIDTSNNQFSLKLSSVIAADTAVY YCARNFGPGSPNYGMDVWGQGTTVTVSSASTKG |
| 89 | 8ANC177HC | VVQLVQSGPGLVKPSQTLSLTCTVSGGSISSGDFYWSWIRQPPGK GLEWIGYIYYSGSTYYNPSLKSRLTISVDTSKNQFSLRLSSVTAADT AVYYCARDLNSRIVGALDAFDIWGQGTMVTVSSASTKG |
| 90 | 8ANC178HC | QVQLVESGGALVQPGGSLRLSCAASGFSFSSYAMSWVRQAPGK GLEWVSAISRSGGSTYYADSVKGRFTISIDNSNNTLYLQMNSLRVE DTAVYYCAKREAFYYGAGGYGMDVWGQGTTVTVSSASTKG |
| 91 | 8ANC179HC | EVQLVESGGGLVKPGGSLRLSCEASGFTFTNAWMNWVRQAPGK GLEWVGRIKSQTHGGTTRYAAPVKGRFTISRDDSKHTLYLQMDRL TTEDTAVYYCTGTITGSTFYYYGMDVWGQGTTVTVSPASTKG |
| 92 | 8ANC17HC | EVQLVESGGGLLQPGGSLRLSCAASGFSNDFEMNWVRQAPGK GLEWVSYISNDGTMIHYADSVKGRFTISRDNAKKSLFLQMNSLRA EDTAVYYCARLAEVPPAIRGSYYYGMDVWGQGTTVTVASASTKG |
| 93 | 8ANC180HC | QVQLQESGPGLLRPLETLSLTCSVSGGSIRGYFWSWVRQPAGRG LEWIGRIYSSGTTRFNPSLKSRVRLSIDTAKSEVSLNITSVTAADSA SYFCAGTSPVHGGLDLWGLGLRVTVSSASTKG |
| 94 | 8ANC181HC | HLVQSGTEVKKPGSSVTVSCKAYGVNTFGLYAVNWVRQAPGQSL EYIGQIWRWKSSASHHFRGRVLISAVDLTGSSPPISSLEIKNLTSDD TAVYFCTTTSTYDQWSGLHHDGVMAFSSWGQGTLISVSAASTKG |
| 95 | 8ANC184HC | EVQLVQSGAEVKKPGASVKVSCKVSGYTLTELSIHWVRQAPGKGL EWMGGFDPEDDEAIYEPKFQGRLTMTEDTSTDTAYMELSSLRSE DTAVYYCATADPFKVAQDEGLYVIFDYWGQGTLVTVSSASTKG |
| 96 | 8ANC185HC | QVQLVESGGGLVQPGGSLRLSCAASGFTFSTHWMHWVRQAPGK GLVWVSRIHSDGRSTSYADSVKGRFTISRDNAKNTLYLQMNSLRA EDTAVYYCARGAAVFGVVIIGGMDLWGQGTTVTVSSASTKG |
| 97 | 8ANC186HC | EVQLVESGGGVVQPGGSLRLSCAASGFMFKNYAMHWVRQPPGK GLEWVAVIWYGGRDQNYADSVKGRFTISRDDSDNTLYLQMNSLR AGDTAVYFCARNSQVGRLMPAAGVWGQGTLVTVSSASTKG |

TABLE A-continued

| Seq ID No. | Antibody | Heavy Chain Amino Acid Sequence |
|---|---|---|
| 98 | 8ANC187HC | EVQLVESGGGLIQRGGSLRLSCVASGFPVSDNHMSWVRQAPGK GLEWVSIIYSDGGTYYADSVKGRFTISRDNSKNTVYLQMNSLRAT DTAVYYCARDPGFHYGLDVWGQGTTVTVSSASTKG |
| 99 | 8ANC188HC | VVQLVESGGGLVQPGGSLRLSCAASGFAFRSYWMSWVRQAPGR GLEWVANIKQDGSEKYYADSVKGRFTISRDNTKNSLYLQMNSLRA EDTAVFYCASRGDRYGPIDYWGQGTLVTVSSASTKG |
| 100 | 8ANC191HC | VVQLVESGTEVKKPGSSVKVSCKASGGTFSGSDISWVRQAPGQG LEWMGGIIPMFDIENHAEKFRGRLTITAVKSTGAAYMELSSLRSED AAVYYCARSSGNYDFAYDIWGQGTRVIVSSASTKG |
| 101 | 8ANC193HC | EVQLVQSGAEVKKPGSSVKVSCKASGGTFSTYAFSWVRQAPGQ GLEWMGGIIPIFGTENYAQKFQGRVTITADKSTSTAYMELSSLRSE DTAVYYCARDRSSAIGYCSSISCYKGSFDIWGQGTMVTVSSASTKG |
| 102 | 8ANC194HC | EVQLVQSGGGLVQPGGSLRLSCAASGLTFRNFAMSWVRQAPGK GLEWVSSISGSGGSTYYADSVKGRFTISRDNSKNTLYLQMNSLRG EDTAVYFCAKGVGYDILTGLGDAFDIWGQGTVVAVSSASTKG |
| 103 | 8ANC195HC | QIHLVQSGTEVKKPGSSVTVSCKAYGVNTFGLYAVNWVRQAPGQ SLEYIGQIWRWKSSASHHFRGRVLISAVDLTGSSPPISSLEIKNLTS DDTAVYFCTTTSTYDKWSGLHHDGVMAFSSWGQGTLISVSAAST KG |
| 104 | 8ANC196HC | VVQLVQSGTEVKKPGSSVKVSCKASGGTFSGSDISWVRQAPGQG LEWMGGIIPMFDIEDHAQKFRGRLTITADKSTGAAYMELSSLRSED AAVYYCARSSGNYDFAFDIWGQGTRLIVSSASTKG |
| 105 | 8ANC20HC | QVQLGESGGGLVEPGGSLRLSCAASGFLFSDYQMSWIRLAPGKG LEWISFISGFGSVYYADSVEGRFTISRDNARNSLYLQMNNLRAEDT AVYYCARAYGTGNWRGLYYYYYGMDVWGHGTTVTVSSASTKG |
| 106 | 8ANC21HC | QLQLVESGGGVVQPGRSLRLSCAASGFTFSTYTMHWVRQAPGK GLEWVAVISYDGTNKYYADSVKGRFTISRDNSKNTLYLQMNSLRG EDTAVYYCARSPSYYFDYWGQGTLVTVSAASTKG |
| 107 | 8ANC24HC | QVQLVQSGAEVKMPGASVKVSCKVSGYSLTELSIHWVRQAPGKR LEWMGGFDPEDDERIYAQKFQDRVTMTEDTSTDTAYMDLNSLRS EDTAVYYCTTGGLYCSSISCIMDVWGQGTTVIVSSASTKG |
| 108 | 8ANC25HC | QVQLVQSGAEVKKPGASVKVSCKVSGYTLTELSIHWVRQAPGKR LEWMGGFDPEDGERIYAQKFQGRVTMTEDTSTDTAYMELNSLRS DDTAVYYCATGGLYCSSISCIMDVWGQGTTVTVSSASTKG |
| 109 | 8ANC27HC | QVQLVQSGAEVKKPGASVKVSCKVSGYTLTELSIHWVRQAPGKG LEWMGGFDSEDGEAIYKQNFQGRVTMTEDTSTDTAYMELSRLRS EDTAVYYCATADRFKVAQDEGLFVIFDYWGQGNPGHRLLSLHQG PIGLPPGTLPPKATSGHAARR |
| 110 | 8ANC31HC | QVQLVESGGGVVQPGRSLRLSCAASGFTFSSYAMHWVRQAPGK GLEWVAVISYDGSNKYYADSVKGRFTISRDDSKSTVYLQINSLRAA DTAVYFCAREGGLRFLEWLFWGQGTLVTVSSGESSASTKG |
| 111 | 8ANC33HC | EFQLVQSGGGLVKPGGSLRLSCTGSTFSFSSDDMNWVRQAPGK GLEWVSSMSDSGSHIYYADFVKGRFTISRDNAKKSLYLQMNSLRA EDTAVYYCAQSRPPQRLYGMDVWGQGTTVTVSSASTKG |
| 112 | 8ANC34HC | QVQLVQSGAEVKKPGASVKVSCKVSGYTLTELSIHWVRQAPGKG LEWMGGFDPEDGEASFEPKFQGRLTMTEDTSTDTAYMELSSLRS EDTAVYYCATADPFKVAQDEGLYVIFDYWGQGTLVTVSSASTKG |
| 113 | 8ANC36HC | QVQLVESGGGVVQPGKSLRLSCAASGFTFSTHAMHWVRQAPGK GLDWVAVISHDGDNQYYADAVKGRFTISRDDSRDTVFLQMNSLRT EDTGVYYCAADSSGSNWFDYWGQGILVTVSSASTKG |
| 114 | 8ANC38HC | EPMFQPGQSGGVVVQSGESLHLSCEASGFKFASQMMHWVRHVP GRGLEWVALISWDGSGKLFADSVRGRFTIHRWNDRNSLYLDVKN VRPEDAAIYYCTRNGFDVWGQGILVTVSSASTKG |
| 115 | 8ANC39HC | QVQLLQSGAEVKKPGASVKVSCKVSGYTLTELSIHWVRQAPGKGL EWMGGFDPEDDEAIYEPKFQGRLTMTEDTSTDTAYMELSSLRSE DTAVYYCATADPFKVAQDEGLYVIFDYWGQGTLVTVSSASTKG |

TABLE A-continued

| Seq ID No. | Antibody | Heavy Chain Amino Acid Sequence |
|---|---|---|
| 116 | 8ANC3HC | QVHLQESGPRLVRSSETLSLTCSVPGGSIVNPITNYYWSWIRQSPRKGLQWIGDIYYTGTSSRNPSLDSRVSISMDVSRKQISLTLYSVTAADTAVHYCASQSLSWYRPSGYFESWGQGILVTVSSASTKG |
| 117 | 8ANC43HC | QVQLVQSGAEVKKPGSSMKVSCKSSGGTFSNHAISWVRQAPGKGLEWMGGIIPMSGTTNYLQKFQGRVTITADEFATTAYMELSSLTSEDTAVYYCARARADSHTPIDAFDIWGPGTRVIVSSASTKG |
| 118 | 8ANC46HC | QVQLVQSGTEVKKPGSSVKVSCKASGGTFSDSDIAWVRQAPGQGLEWMGGITPMFDMAKSAQKFRGRLIITADKSTGTAYMELSSLRYEDAAVYFCARSSGNFEFAFEIWGQGTKIIVSLASTKG |
| 119 | 8ANC48HC | QVQLVQSGAEVKKPGASVKVSCKASGYTFTSYDINWVRQATGQGLEWMGWMNPNSGNTGYAQTFQGRVTMTRNTSISTAYMELSSLRSEDTAVYYCARDRWLPQYYYYGMDVWGQGTTVTVSSASTKG |
| 120 | 8ANC49HC | FVQLVESGGGLVQPGGSLRLSCAASGFNFNTYWMNWVRQAPGKGLEWVANMKEDGSEKYYVDSVKGRFTISRDNAKNSLYLQMNSLRAEDTAVYYCARNPESRCIVGRNRGWCRYFDLWGRGSLVTVSPASTKG |
| 121 | 8ANC51HC | LVQLVESGGGVVQPGRSLRLSCAASGFTFSTYAMHWVRQAPGKGLEWVAVISYDGSNKFYADSVKGRFTISRDNSKNTLYLQMNSLRAEDTAVYYCARPKFLPGADIVVVAATPFDYWGQGNPGHRLLSFHQGPIGLPPG |
| 122 | 8ANC57HC | PMFQPGQSGGVVVQSGESLHLSCEASGFKFASQMMHWVRHVPGRGLEWVALISWDGSGKLFADSVRGRFTIHRWNDRNSLYLDVKNVRPEDAAIYYCTRNGFDVWGQGILVTVSSASTKG |
| 123 | 8ANC58HC | QVQLVQSGAEVKKPGASVKVSCKVSGHTLSELSINWVRHVPGKGLEWMGGLDPEDGEAIHEPKFQGRLTMTEDTSTDTAYVELSSLRSEDTAMYYCATADPFKVAQDEGLYVIFDYWGQGTLVTVSSASTKG |
| 124 | 8ANC5HC | QVQLVQSGAEVRKPGSSLKVSCKSSGGTFSRFWNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG |
| 125 | 8ANC60HC | LVQLVESGGGVVQPGKSLRLSCATSGFTFSTYGMHWVRQAPGKGLEWVAVIWYDGSYKYYADSVKGRFTISRDNSKNTLFLQMNSLRAEDTAMYYCGREMAVGGTKALDHWGQGTLVTVSSASTKG |
| 126 | 8ANC63HC | QVQLVQSGAEAKRPGDSVKVSCKASGYTFTEYYIHWVRQTPGQGFEWMGIITPGAGNTTYAQKFQGRITVTRDTSAATVYMELSNLTSEDTAVYFCSRGVSFWGQGTLVTVSSASTKG |
| 127 | 8ANC65HC | QVQMVASGGGLVKPGGSLRLSCEASGFTFSDYYMSWVRQAPGKGLEWISYITSGGNALYYADSVKGRFTISRDNAKNSLYLQMNSLRAEDTAVYYCARDLLHAHDFGRQGTLVTVSSASTKG |
| 128 | 8ANC67HC | QVQLVESGGGVVQPGRSLRLSCATSGFTSKNYGVHWVRQAPGKGLEWVAVIWYDGSNKFYADSVKGRFTISRDRSKNMVYLQMNSLRVEDTAIYYCARDSVAFVLEGPIDYWGQGTLVTVSSASTKG |
| 129 | 8ANC69HC | QVQLVQSGAEVKKPGASVKVSCKASGYTFTDYYIHWVRQAPGQGLEWMGWINPSTGGTNFVQKFLGRVTMTSDTSINTAYMELRRLKNDDAAIYYCATYSTRQFFHYYYVTDVWGQGTTVTVSSASTKG |
| 130 | 8ANC6HC | QVQLVQSGAEVKKPGSSVKVSCRASGGSFGNYAINWVRQAPMQGLEWMGGIIPIFGTTNYAQNFRGRVTINADTFTNTVNMDLSSLRSEDTAVYYCGRSINAAVPGLEGVYYYYGMAVWGQGTTVTVSSASTKG |
| 131 | 8ANC70HC | QVQLHQWGAGLLKPSDTLSLTCGILGVSPPGSLTGYYWTWIRQPPGKGLEWIGEVYHSGSTNYNPSLASRVTISMGTTKTQFSLRLTSVTAADSAVYYCASGKVWGITARPRDAGLDVWGQGTTVTVSSASTKG |
| 132 | 8ANC71HC | EVQVVESGGGLVQPGGSLRLSCVASGFTFSEYWMSWVRQAPGKGLEWVATIKRDGSEESYVDSVKGRFTISRDNAKNSLYLQMNSLRAEDTAVYYCARVRDPNYNLHFDSWGQGTLVTVSSASTKG |
| 133 | 8ANC72HC | QVQLVESGGGLIQPGGSLRLSCEASGFAVGDINYMSWVRQAPGKGLEWVSVLYSGGSSQYADSVKGRFTISRDNSRNTLYLQMDNLRAEDTAVYYCARGLRVYFDLWGQGILVTVSSASTKG |

TABLE A-continued

| Seq ID No. | Antibody | Heavy Chain Amino Acid Sequence |
|---|---|---|
| 134 | 8ANC74HC | QVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG |
| 135 | 8ANC75HC | QVQLQESGPGLVKPSETLSLTCTVSGGSISSRSYYWGWIRQPPGKGLEWVGSIYYTGSTYYSPSLKSRVTISVDTSQNQFSLKLNSVTAADTAVYYCARQKGSGTSLLYWGQGTLVTVSSASTKG |
| 136 | 8ANC76HC | QVQLVQSGSELKKPGASVKVSCKASGYTFTSYAINWVRQAPGQGLEWMGWINTNTGNPTYAQGFTGRFVFSLETSVSTAYLQINSLKAEDTAVYYCARDLLESRTYYNDIRDCWGQGTLVTVSSASTKG |
| 137 | 8ANC78HC | QVQLQESGSGLVKPSGTLSLTCAVSNGPISSGNWWSWVRQTPEKGLEWIGEVYHSGSTNHNPSLKSRATILVDKSKNQFSLNLRSVTAADTAVYYCARVRGSWNFDYWGQGILVTVSSASTKG |
| 138 | 8ANC79HC | QHQLVPCVAEVRKPGASVKVSCKVSGYTLTEISMHWVRQAPGKGLEWMGGFDREDGETIYAQKFQGRVTMTEDTSTDTAYMELSSLRSEDTAVYYCATTYLAVVPDGFDGYSSWYWFDPWGQGTLVTVSSASMQGPMLLSPTGTLLPRAPLVQTRPGP |
| 139 | 8ANC7HC | QVQLVQSGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG |
| 140 | 8ANC80HC | QVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG |
| 141 | 8ANC82HC | QVHLEESGPGLVKTSQTLSLTCSVSSYSISRSGYFWTWIRQRPGKGLEWIGYIYFNGRTTYNPSLKSRITISRDTSHSQFSLTLNSLSAADTAVYYCGRCQDGLASRPIDFWGQGTLVTVSSASTKG |
| 142 | 8ANC83HC | QVQLVESGGGVVQPGKSLRLSCAISGFLFNNYGGQWVRQAPGKGLEWVAAISYDGNNRYYADSAKGRFLISRDTPKNILYLQIYSLRLDDTAVYYCARDSVSKSYSAPPEFWGQGTVVTVSSASTKG |
| 143 | 8ANC91HC | QLQLQESGPGLVKPSETLSLTCSVSDGSINSNSYYWAWIRQSPGKGLEWIGSVYYFGGTYYSPSLKSRVTMSVDRSKNQFSLNVSSVTAADTAIYYCARHVRPYDRSGYPERPNWFDPWGRGTLVTVSSASTKG |
| 144 | 8ANC92HC | RVQLVQSGAEVKKPGSSVTVSCKASGGSFSSYAISWVRQAPGQGLEWVGGVKVMFGTVHYSQKVQGRVTITADDSTGTSYLELSGLRSADTAVYYCARNAGAYFYPFDIWGQGTLIIVSSASTKG |
| 145 | 8ANC93HC | QVQLVQSGAEVKKPGASVKVSCKASGYTFTRYHIHWVRHAPGQGLEWMGKINPSRASTKYAKKFQDRVTMTRDTSTSTVYMELSSLRGDDTAVYYCGREMGTFTLLGVVIDHYDFYPMDVWGQGTPVTVSSASTKG |
| 146 | 8ANC9HC | QVQLVQSGAEVRKPGSSLKVSCKSSGGTFSRYVVNWVRQAPGQGLEWMGGIIPIFGIAKYAQKFQDRVTMTADESKNTVYLDFSSLRSGDTAVYYCARDRGDTRLLDYGDYEDERYYYGMDVWGQGTTVTVSSASTKG |
| 147 | 12A10HC | SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLPWGQGTQVIVSPASTKG |
| 148 | 12A12HC | SQQLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSSASTKG |
| 149 | 12A13HC | SQQLVQSGTQVKKPGASVRISCQASGYSFTDYVLHWYRQAPGQGLEWMGWIKPVYGARNYARRFQGRINFDRDIYREIAFMDLSGLRSDDTALYFCARDGSGDDTSWYLDPWGQGTLVIVSSASTKG |
| 150 | 12A16HC | SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLPWGQGTLVIVSSASTKG |
| 151 | 12A17HC | SQQLVQSGTQVKKPGASVRVSCQASGYTFMNYIIHWWRQAPGQRLEWMGWINPVFGARNYAHRFQGRINFDRDINRETFQMELTGLRSDDTAVYYCARDGSGDARDWHLDPWGQGTLVIVSSASTKG |

TABLE A-continued

| Seq ID No. | Antibody | Heavy Chain Amino Acid Sequence |
|---|---|---|
| 152 | 12A1HC | SQHLVQSGTQVKKPGASVRVSCQASGYTFTNYILHWWRQAPGQGLEWMGLIKPVFGAVNYARQFQGRIQLTRDINREIAFLDLSGLRSDDTAVYYCARDESGDDLKWHLHPWGQGTQVIVSPASTKG |
| 153 | 12A20HC | SQQLVQSGTQVKKPGASVRVSCQASGYTFMNYIIHWWRQAPGQRLEWMGWINPVFGARNYAHRFQGRINFDRDINRETFQMDLTGLRSDDTAVYYCARDGSGDARDWHLHPWGQGTLVIVSSASTKG |
| 154 | 12A21HC | SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKG |
| 155 | 12A22HC | SQQLVQSGTQVKKTGASVRVSCQASGYDFTKYLIHWWRQAPGQGLEWMGWMKPVYGATNYAHRFQGRISFTRDIYREIAFMDLNGLRSDDTAVYFCARDGGGDDRTWLLDAWGQGTLVIVSSASTKG |
| 156 | 12A23HC | SQHLVQSGTQVKKPGASVRVSCQASGYTFTNYILHWWRQAPGQGLEWMGLIKPVFGAVNYARQFQGRIQLTRDINREIAFLDLSGLRSDDTAVYYCARDESGDDLKWHLHPWGQGTQVIVSPASTKG |
| 157 | 12A27HC | SQQLVQSGTQVKKPGASVRISCQASGYTFTDYVLHWWRQAPGQGLEWMGWIKPVYGARNYARRFQGRINFDRDIYREIAFLDLSGLRSDDTARYFCARDGSGDDTSWHLHPWGQGTLVIVSAASTKG |
| 158 | 12A2HC | SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSAASTKG |
| 159 | 12A30HC | SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSAASTKG |
| 160 | 12A37HC | SQQLVQSGTQVKKTGASVRVSCQASGYDFTKYLIHWWRQAPGQGLEWMGWMKPVYGATNYAHRFQGRISFTRDIYREIAFMDLNGLRSDDTAVYFCARDGGGDDRTWLLDAWGQGTLVIVSSASTKG |
| 161 | 12A46HC | SQQLVQSGAQVKKPGASVRVSCQASGYTFTNHFLHWWRQAPRQGLEWMGWINPVHGGRNYARRFQGRINFGRDVYQETAYMELSGLRNDDTATYFCARGGGDGRNWHLHPWGQGTLVIVSAASTKG |
| 162 | 12A4HC | SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKG |
| 163 | 12A55HC | SQQLVQSGAQVKKPGASLRVSCQASGYTFMNYLLHWWRQAPGQGLEWMGWINPVYGAVNYAHRFQGRLTFSRDVYREIAYMDLNGLRSDDTAVYFCARDGSGDDRNWHLDPWGQGTLVIVSSASTKG |
| 164 | 12A56HC | SQQLVQSGTQVKKPGASVRVSCQASGYTFTNYILHWWRQAPGRGLEWMGLIKPVYGAVNYARQFQGRIQLTRDIYREIAFLDLSGLRPDDTAVYYCARDESGYDLNWHLDSWGQGTQVIVSPASTKG |
| 165 | 12A6HC | SQQLVQSGTQVKKPGASVRVSCQASGYTFTDYVLHWWRQAPGQGLEWMGWIKPVYGARNYAHRFQGRINFDRDVYREIAYMDLSGLRSDDTAVYFCARDGSGDATSWHLHPWGQGTLVIVSSASTKG |
| 166 | 12A7HC | SQQLVQSGTQVKKPGASVRVSCQASGYTFMNYIIHWWRQAPGQRLEWMGWINPVFGARNYAHRFQGRINFDRDINRETFQMELTGLRSDDTAVYYCARDGSGDARDWHLDPWGQGTLVIVSSASTKG |
| 167 | 12A9HC | QVTLVQSGAEVKKPGASVRISCRASGFTFDDYSDYSFIPTTYLIHWFRQAPGQGLEWMAWINSVNGGRNIARQFQGRVTVARDRSNSIAFLEFSGLRHDDTAVYFCARDRRDDDRAWLLDPWGQGTRVTVSSASTKG |
| 168 | LSSB2339HC | QVRLEQSGAAMRKPGASVTLSCQASGYNFVKYIVHWVRQKPGLGFEWVGMIDPYRGRPWSAHKFQGRLSLSRDTSMEILYMTLTSLTSDDTATYFCARAEAASDSHSRPIMFDHWGQGSRVTVSSASTKG |
| 169 | LSSB2351HC | QVRLEQSGTAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG |
| 170 | LSSB2361HC | QVRLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG |

TABLE A-continued

| Seq ID No. | Antibody | Heavy Chain Amino Acid Sequence |
|---|---|---|
| 171 | LSSB2364HC | QVRLEQSGAAVRKPGASVTLSCQASGYNFVNYIIHWVRQRPGLDF EWVGMIDPYRGRPWSAHKFQGRLSLSRDVSTEILYMTLSSLRSDD TATYFCARAEAESQSHSRPIMFDFWGQGSRVTVSSASTKG |
| 172 | LSSB2367HC | QVRLSQSGAAIKKPGASVTISCETEGYTFINYIIHWVRQPPGRGFE WLGMIDPRNGRPWFGQSVQGRLSLRRDTYTEVVYMTLSGLTSDD AGHYFCARNEPQYHDGNGHSLPGMFDYWGQGTLVAVSSASTKG |
| 173 | LSSB2416HC | QVRLSQSGAAVKKPGASVTIVCETEGYNFIDYIIHWVRQPPGRGFE WLGMIDPRNGRPWSGQKVHGRLSLWRDTSTEKVYMTLTGLTSD DTGLYFCGRNEPQYHDDNGHSLPGMIDYWGQGTMVTVSSASTKG |
| 174 | LSSB2434HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 175 | LSSB2483HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 176 | LSSB2490HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 177 | LSSB2503HC | QVRLEQSGAAVRKPGASVTLSCQASGYNFVRYIIHWVRQRPGLDF EWVGMIDPYRGRPWSAHKFGGRLSLTRDVSTEILYMTLSLRSDD TATYFCARAEAESQSHSRPIMFDSWGQGSRVTVSSASTKG |
| 178 | LSSB2525HC | QVRLEQSGNAVRKPGASVTISCQASGYNFVKFFIHWVRQRPGQG FEWVGMIEPFRGRPWSAGNFQGRLSLSRDVSTETLYMTLNNLRS DDTAVYFCARLEAESDSHSRPIMFDHWGHGSLVTVSSASTKG |
| 179 | LSSB2530HC | QVRLEQSGAAMRKPGASVTLSCQASGYNFVKYIIHWVRQKPGLG FEWVGMIDPYRGRPWSAHKFQGRLSLSRDTSMEILYMTLTSLKSD DTATYFCARAEAASDSHSRPIMFDHWGQGSRVTVSSASTKG |
| 180 | LSSB2538HC | QVRLFQSGAAMRKPGASVTISCEASGYNFLNYFVHWVRQRPGRG FEWLGMINPRGGRPWSAQSVQGRLTLTRDTSTEMFYMRLDGLRS DDTATYFCARNEADYHDGNGHSLRGMFDYWGQGSLITVSSASTKG |
| 181 | LSSB2554HC | QVRLEQSGAAMRKPGASVTLSCQASGYNFVKYIIHWVRQKPGLG FEWVGMIDPYRGRPWSAHKFQGRLSLSRDTSMEILYMTLTSLKSD DTATYFCARAEAASDSHSRPIMFDHWGQGSRVTVSSASTKG |
| 182 | LSSB2573HC | QVRLSQSGAAIKKPGASVTISCETEGYTFINYIIHWVRQPPGRGFE WLGMIDPRNGRPWFGQSVQGRLSLRRDTYTEVVYMTLSGLTSDD TGLYFCARNEPQYHDGNGHSLPGMFDSWGQGTLVAVSSASTKG |
| 183 | LSSB2578HC | QVQLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 184 | LSSB2586HC | QVRLEQSGAAMRKPGASVTLSCQASGYNFVKYIVHWVRQKPGLG FEWVGMIDPYRGRPWSAHKFQGRLSLSRDTSMEILYMTLTSLKSD DTATYFCARAEAASDSHSRPIMFDHWGQGSRVTVSSASTKG |
| 185 | LSSB2609HC | QVRLFQSGAAMKKPGASVTISCEASGYNFMNYFVHWVRQRPGR GFEWLGMINPRGGRPWSAQSVQGRLTLTRDISTEMFYMRLDGLR SDDTATYFCARNEADYHDGNGHSLRGMFDYWGQGSLITVSSAST KG |
| 186 | LSSB2612HC | QVRLEQSGTAMRKPGASVTLSCQASGYNFVKYIVHWVRQKPGLG FEWVGMIDPYRGRPWSAHKFQGRLSLSRDTSMEILYMTLTSLKSD DTATYFCARAEAASDSHSRPIMFDHWGQGSRVTVSSASTKG |
| 187 | LSSB2630HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 188 | LSSB2640HC | QVRLFQSGAAMRKPGASVTISCEASGYNFMNYFVHWVRQRPGR GFEWLGMINPRGGRPWSAQSVQGRLTLTRDTSTEMFYMRLDGL |

TABLE A-continued

| Seq ID No. | Antibody | Heavy Chain Amino Acid Sequence |
|---|---|---|
|  |  | RSDDTATYFCARNEADYHDGNGHSLRGMFDYWGQGSLITVSSAS<br>TKG |
| 189 | LSSB2644HC | QVRLSQSGAAIKKPGASVTISCETEGYTFINYIIHWVRQPPGRGFE<br>WLGMIDPRNGRPWFGQSVQGRLSLRRDTYTEVVYMTLSGLTSDD<br>TGLYFCARNEPQYHDGNGHSLPGMFDSWGQGTLVAVSSASTKG |
| 190 | LSSB2665HC | QVRLFQSGAAMRKPGASVTISCEASGYNFMNYFVHWVRQRPGR<br>GFEWLGMINPRGGRPWSAQSVQGRLTLTRDTSTEMFYMRLDGL<br>RSDDTATYFCARNEADYHDGNGHSLRGMFDYWGQGSLITVSSAS<br>TKG |
| 191 | LSSB2666HC | QVRLEQSGAAMRKPGASVTLSCQASGYNFVKYIIHWVRQKPGLG<br>FEWVGMIDPYRGRPWSAHKFQGRLSLSRDTSMEILYMTLTSLKSD<br>DTATYFCARAEAASDSHSRPIMFDHWGQGSRVTVSSASTKG |
| 192 | LSSB2669HC | QVRLEQSGAAMRKPGASVTLSCQASGYNFVKYIIHWVRQKPGLG<br>FEWVGMIDPYRGRPWSAHKFQGRLSLSRDTSMEILYMTLTSLKSD<br>DTATYFCARAEAASDSHSRPIMFDHWGQGSRVTVSSASTKG |
| 193 | LSSB2680HC | QVRLEQSGVAMRKPGASVTLSCQASGYNFVKYIIHWVRQKPGLG<br>FEWVGMIDPYRGRPWSAHKFQGRLSLSRDTSMEILYMTLTSLKSD<br>DTATYFCARAEAASDIHSRPIILTGPGEYGLDLEHMDWTWRILCLL<br>AVAPGCHSQ |
| 194 | LSSB2683HC | QVRLEQSGAAMRKPGASVTLSCQASGYNFVKYIVHWVRQKPGLG<br>FEWVGMIDPYRGRPWSAHKFQGRLSLSRDTSMEILYMTLTSLKSD<br>DTATYFCARAEAASDSHSRPIMFDHWGQGSRVTVSSASTKG |
| 195 | LSSB344HC | QVRLEQSGTAVRKPGASVTISCQASGYNFVKFFIHGVRQRPGQGF<br>EWVGMIEPFRGRPWSAGNFQGRLSLSRDVSTETLYMTLNNLRSD<br>DTAVYFCARLEAESDSHSRPIMFDHWGHGSLVTVSSASTKG |
| 196 | LSSNEC107HC | QVRLVQSGPQVKTAGASMRVSCEASGYRFLDYIIVWIRQTHGQHF<br>EYVGMINPRGGTPWPSSKFRDRLTLTRDIYTDTFYLGLNNLGSGD<br>TAIYFCARLEADGDDYSPKMFDYWGQGTRIIVSAASTKG |
| 197 | LSSNEC108HC | QVHTFQSGSSMKKSGASVTISCEATGYNIKNYILHWVRQKPGRGF<br>EWVGMIDPINGRPWFGQPFRGRLTLTRDLSTETFYMSLSGLTSDD<br>TATYFCARREADYHDGNGHTLPGMFDFWGPGTLITVSSASTKG |
| 198 | LSSNEC109HC | QVSLVQSGPQVKTPGASMRVSCETSGYRFLDYIIVWIRQTHGQHF<br>EYVGMINPRGGTPWPSSKFRDRLTMTRDIHTDTFYLGLNNLRSDD<br>TAIYFCARLEADGDDYSPKMFDYWGQGTRIIVSAASTKG |
| 199 | LSSNEC110HC | QVRLVQSGPQMKTPGASLRLSCEVSGYRFLDYFIVWVRQTGGQG<br>FEYVGMINPRGGRPWSSWKFRDRLSLTRDIETDTFYLGLNNLRSD<br>DTAIYFCARLEADGDNYSPKMVDYWGQGTKIIVSPASTKG |
| 200 | LSSNEC116HC | QVRLSQSGAAVVKTGASVTISCETEGYNFVNYIIHWVRRPPGRGF<br>EWLGMIDPRNGHPWFAQTVRGRLSLRRDTFKETVYMTLSGLTSD<br>DTGVYFCARNEPQYHSLPGMFDYWGHGTPVTVSSASTKG |
| 201 | LSSNEC117HC | QVRLVQSGAQLKKPGASVTVSCEASGYNFVNYIINWVRQTPGRG<br>FEWVGMIDPRRGRPWSAQKFQGRLTLTRDIDSEKLYMHLSGLRG<br>DDTAVYYCARQDSDFHDGHGHTLRGMFDSWGQGSPVTVSSAST<br>KG |
| 202 | LSSNEC118HC | QVRLVQSGPQVKTPGASMRISCEASGYRFQDYIIVWIRQTHGQGF<br>EYVGMINPRGGTPWSSSKFRDRLSLTRDIYTDTFYLGLNNLGSDD<br>TAIYFCARLEADGGDYSPKMFDYWGQGTRIIVSAASTKG |
| 203 | LSSNEC11HC | QVRLFQSGAAMRKPGASVTISCEASGYNFMNYFVHWVRQRPGR<br>GFEWLGMINPRGGRPWSAQSVQGRLTLTRDTSTEMFYMRLDGL<br>RSDDTATYFCARNEADYHDGNGHSLRGMFDYWGQGSLITVSSAS<br>TKG |
| 204 | LSSNEC122HC | QVRLVQSGPQVKRPGASIRLSCETSGYRFQDYIVAWIRQTRGQRF<br>EFVGMVNPRGGRPWPSSKFRDRVTLTRDIESETFHLGLNDLTSDD<br>TATYFCARLEADGADYSPKMFDFWGQGTKIWSPASTKG |
| 205 | LSSNEC123HC | QVRLEQSGAAVRKPGASVTLSCQASGYNFVNYIIHWVRQRPGLDF<br>EWVGMIDPYRGRPWSAHKFEGRLSLSRDVSTEVLYMTLSSLRSD<br>DTATYFCARAEAESQSHSRPIMFDYWGQGSRVTVSSASTKG |

TABLE A-continued

| Seq ID No. | Antibody | Heavy Chain Amino Acid Sequence |
|---|---|---|
| 206 | LSSNEC127HC | QVRLEQSGAAMRKPGASVTLSCQASGYNFVKYIIHWVRQKPGLG FEWVGMIDPYRGRPWSAHKFQGRLSLSRDTSMEILYMTLTSLKSD DTATYFCARAEAASDSHSRPIMFDHWGQGSRVTVSSASTKG |
| 207 | LSSNEC18HC | QVRLSQSGAAVMKTGASVTISCETEGFNFVNYIIHWVRRPPGRGF EWLGMIDPRNGHPWFAQTVRGRLSLRRDTFNEIVYMTLSGLTTDD TGLYFCARNEPQYHSLPGMFDYWGQGTPVTVSSASTKG |
| 208 | LSSNEC24HC | QVRLSQSGAAMKKPGASVTISCETEGYTFINYIIHWVRQPPGRGFE WLGMIDPRNGRPWFGQSVQGRLSLRRDTYTEVVYMTLSGLTSDD AGLYFCARNEPQYHDGNGHSLPGMFDYWGQGTLVAVSSASTKG |
| 209 | LSSNEC29HC | QVRLSQSGAAVVKTGASVTISCETEGYTFVNYIIHWVRQSPGRGF EWLGMIDPRNGHPWFGQRLRGRLSLRRDRSTETVFMTLSGLTSD DTAIYFCARNEPQYYDGSGHSLPGMFDYWGQGTRVVVSSASTKG |
| 210 | LSSNEC2HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 211 | LSSNEC33HC | QVRLVQSGPQVKTPGASIRLSCEASGYRFLDYIVWVRQTPGQGF EYVGMINPRGGRPWSSWKFRDRLSLTREIDTDTFYLGLSNLRSDD TAIYFCARLEADGDDYSPKMVDYWGQGTKIIVSAASTKG |
| 212 | LSSNEC34HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 213 | LSSNEC3HC | QVRLEQSGAAVRTPGASVTLSCQASGYKFVNYIIHWVRQRPGLAF EWVGMIDPYRGRPWSAHSFEGRLSLSRDVSMEILYMTLTSLRSD DTATYFCARAEAESQSHSRPIISTSGAR |
| 214 | LSSNEC46HC | QVQFFQSGSSMKKSGASVTISCEATGYNIKNHILHWVRQKPGRGF EWVGMIDPINGRPWFGQAFRGRLTLTRDLSTETFYMSLSGLTSDD TATYFCARREADYHDGNGHTLPGMFDWGPGTLVTVSSASTKG |
| 215 | LSSNEC48HC | QVRLSQSGAAVVKTGASVTISCETEGYTFVNHIIHWVRQPPGRGF EWLGMIDPRNGHPWFGQRLRGRLSLRRDRSTETVFMTLSGLTSD DIGIYFCARNEPQYFDGSGHSLPGMFDYWGQGTRVWSSASTKG |
| 216 | LSSNEC52HC | QVRLSQSGAAVVKTGASVTISCETEGYTFVNYIIHWVRQPPGRGF EWLGMIDPRNGHPWFGQRLQGRLSLRRDRSTETVFMTLSGLTSD DTGIYFCARNEPQYYDGSGHSLPGMFDYWGQGTRVVSSASTKG |
| 217 | LSSNEC56HC | QVRLVQSGPQVKTPGASMRVSCEASGYRFLDYIIVWIRQTHGQHF EYVGMINPRGGTPWPSSKFRDRLSLTRDIHTDTFYLGLNNLGSDD TAIYFCARLEADGDDYSPKMFDHWGQGTRIIVSAASTKG |
| 218 | LSSNEC60HC | QVRLEQSGAAVKKPGASVTISCQASGYNFVKFFIHWVRQRPGQG FEWVGMIEPYRGRPWSAGNFQGRLSLSRDVSTETLYMTLNNLRS DDTAVYFCARLEAESDSHSRPIMFDHWGHGSLVTVSSASTKG |
| 219 | LSSNEC66HC | QVRLSQSGAAVMKTGASVTISCETEGYNFVNYIIHWVRRPPGRGF EWLGMIDPKNGHPWFAQAVRGRLSLRRDTFNEVVYMTLSGLTSD DTGLYFCARNEPQYHDGNGHSLPGMFDFWGQGTLVTVSSASTKG |
| 220 | LSSNEC70HC | QVRLSQSGAAVVKTGASVTISCETEGYTFVNYIIHWVRQPPGRGF EWLGMIDPRNGHPWFGQRFRGRLSLRRDRSTETVFMTLSGLTSD DNGIYFCARNEPQYYDGSGHSLPGMFDYWGQGTRVVVSSASTKG |
| 221 | LSSNEC72HC | QVRLEQSGAAVRKPGASVTLSCQASGYNFVNYIIHWVRQRPGLDF EWVGMIDPYRGRPWSAHKFQGRLSLSRDVSTEILYMTLSSLRSDD TATYFCARAEAESQSHSRPIMFDFWGQGSRVTVSSASTKG |
| 222 | LSSNEC7HC | QVRLEQSGAAVRKPGASVTLSCQASGYNFVNYIIHWVRQRPGLDF EWVGMIDPYRGRPWSAHKFQGRLSLSRDVSTEILYMTLNSLRSD DTATYFCARAEAESQSHSRPIMFDSWGQGSRVTVSSASTKG |
| 223 | LSSNEC82HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |

TABLE A-continued

| Seq ID No. | Antibody | Heavy Chain Amino Acid Sequence |
|---|---|---|
| 224 | LSSNEC89HC | QVRLEQSGGALRKPGASVTLSCQASGYNFVKYIIHWVRQRPGLGF EWVGMIDPYRGRPWYAHSFAGRLSLSRDTSTETLYMTLSSLKSD DTATYFCARAEAASDSHSRPIMDWTWRILCLLAVVPASTKG |
| 225 | LSSNEC8HC | QVRLFQSGAAMRKPGASVTISCEASGYNFMNYFVHWVRQRPGR GFEWLGMINPRGGRPWSAQSVQGRLTLTRDTSTEMFYMRLDGL RSDDTATYFCARNEADYHDGNGHSLRGMFDYWGQGSLITVSSAS TKG |
| 226 | LSSNEC94HC | QVRLEQSGAAMRKPGASVTLSCQASGYNFVKYIVHWVRQKPGLG FEWVGMIDPYRGRPWSAHKFQGRLSLSRDTSMEILYMTLTSLKSD DTATYFCARAEAASDSHSRPIMFDHWGQGSRVTVSSASTKG |
| 227 | LSSNEC95HC | QVRLVQSGPQVKRPGASIRLSCESSGYRFQDYIVAWIRQTRGQGF EFVGMVNPRGGRPWPSSRFRDRVTLTRDIESETFYLGLNDLTSDD TATYFCARLEADGSDYSPKMFDFWGQGTKIVVSPASTKG |
| 228 | LSSNEC9HC | QVRLVQSGAQLKKPGASVTVSCEASGYNFVNYIINWVRQTPGRSF EWVGMIDPRRGRPWSAQKFQGRLTLTRDIDSEKLYMHLSGLRGD DTAVYYCARQDSDFHDGHGHTLRGMFDSWGQGSPVTVSSASTKG |
| 229 | LSSB2055HC | QVQLVQSGPELMKPGSSVKVSCRASGDNFLTSTFNWLRQAPGQ RLEWMGRFIPSLGLITSAPKFSDRLTITADQATLTAYMELTGLTSED TALYYCARGLCRGGNCRLGPSGWLDPWGRGTQVTVSSASTKG |
| 230 | LSSB2066HC | QVVLIQSGAEVKRPGSSVKVSCKASGGSFPITWVRQAPGHGLEW MGGINPFFGTTNYAQKFQGRVSITADESTSTTYLHLSDLRSEDTAV YFCARENREKWLVLRSWFAPWGQGTLVTVSSASTKG |
| 231 | LSSB2068HC | EESGPGLVKPSQTLSLTCSVSGDSVSSGGYFWSWIRQHPTKGLE CLGYVYYTGNTYYNPSLKSPPTIEVAMANNQVSLKLGSVTAADTA VYYCARIKRFRGGNYFDTWGHGLLVTVSSASTKG |
| 232 | LSSB2080HC | LAQLEQSGGGVVKPGGSLRLPCAASGFTFIDYYMAWIRLAPGKGL EWLSYISKNGDYTKYSESLKGRFTISRDNAKNLVILQLNRLRADDT AIYFCARADGLTYFGELLQYIFDLWGQGARVIVSSASTKGPSVFPL APSSKSTSGHASV |
| 233 | LSSB2133HC | QVQLVQSGAEVKKPGASVKISCKASGYSFRNYAVHWVRQAPGQ GLEWMGEINGGNGNTEYSQKSQGRLTITRDISATTAYMELSSLRS DDTAVYYCARVAYVHVVTTRSLDNWGQGTLVTVSSASTKG |
| 234 | LSSB2182HC | QVQIRQSGPGLVKPLETLSLSCIVFGGSFIAYHWTWIRQAPLKGLE WIGDIDQGGDITYSPSLKSRVTMSVDRSKSQFSLKLSSVTAADAAV YYCVRGPPNRYAVTSFTSGTHRERSSYYFDYWGPGTLVTVSSAS TKG |
| 235 | LSSB218HC | KAPATLSLSPGERATLSCRASQSVGSDLAWYQQKPGQAPRLLIYD ASNRATAIPARFSGSGSGTDFTLSISSLEPEDFAVYFCQQRYDKIT FGQGTRLEIQRTVAAPSVFIFPPSDEQ |
| 236 | LSSB2277HC | FVQLVESGGGVVQPGTSLRLSCTTSGFIFSDYGMHWVRQAAGKG LEWVAVIWHDGSNRFYADSVKGRFTISRDNSKNAVYLEMNNLRVE DTALYYCARTSMDIDYWGQGTPVTVSSASTKG |
| 237 | LSSB2288HC | QVYLVQSGPELKKPGASVKISCKASGYNFPKYAIHWVRQAPGQGL QWMGWINGDNGDARYSQKLQGRVTPSTDTSASVVYMELKRLRS EDTAVYYCARALYPWEIGGVPSTMGDDYWGQGTLITVSSASTKG |
| 238 | LSSB331HC | QVHLQQWGAGLLKPSETLSLTCAVSGGSFSGFFWTWIRQSPGKG LEWIGEVNHSGFTHSNPSLESRATISVAASNTQFSLRLASVTAADT AIYFCALRYFDWSPFRRDTYGTDVWGQGTTVIVSSASTKG |
| 239 | LSSNEC101HC | QVQLVQSGAELKKPGSSVKVSCKASGGTFNNHTFNWVRQAPGQ GLEWMGRTIPILGSRDYAKTFQDRVTIIADKSTSTVYLELR TGVYYCATSMYYFDSGGYYRNTDLDKWGQGSLVTVSSASTKG |
| 240 | LSSNEC106HC | GLDLEHDGHHKEEPRASVTVSCEASGYNFVNYIIHWVRLTPGRGF EWMGMIDPRRGRPWSAQKFQGRLTLTRDIDSERLYMQLSGLRGD DTAVYFCARQEPDFHDGHGHTLRGMFDSWGQGSPVSVSSASTKG |
| 241 | LSSNEC112HC | QVQLVQSGAELKKPGSSVKVSCKASGGTFSNYAINWVRQAPGQG FEWMGGIIPLFATPTYAQKFQGRVRITADDSTSTAYMELSSLRSDD TAVYFCARPNVVRSALDYWGQGTLVTVSSASTKG |

TABLE A-continued

| Seq ID No. | Antibody | Heavy Chain Amino Acid Sequence |
|---|---|---|
| 242 | LSSNEC115HC | QARLDQWGTGLLKPSETLSLKCAVFGVLFTDYNWTWVRQSPGKG LEWIGHLDHRGGGNYNPSLESRVTISLDYSKAQFSLHLKSVTVADT ALYYCAGAVKGFWFDEVYNWFGPWSQGTLVTVASASTKG |
| 243 | LSSNEC124HC | QVQLQESGPGLVKPSGTLSLTCAVSGASISSRNWWTWVRQPPGK GLEWIGEIYESGATNYNPSLKSRVTISVDKSKNQFSLRLTSVTAAD TAVYFCARLMTFGGLIGTLDYWGQGTLVTVLQPPPRAHRYHPRNL LQEHLCARVMP |
| 244 | LSSNEC125HC | QVQLVQSGAEVKKPGSSVKVSCKASGGTFSTYAISWVRQAPGQG LEWMGGIIPSFSMSNYAQDFQGRLTITADESTSSVYMELNSLRSE DTAVYYCARDFPRFHRLVGNYDFWRGTLDRFSYMDLWGRGTAV TVSSASTKG |
| 245 | LSSNEC126HC | QVHLVQSGAEAKRPGSSVRVSCRASGGDFSSYTLSWVRQAPGQ GIEWMGGVVPMLDTVHYAQKFQGRLTLSVDEGTSTAYMELSSLR SEDTAMYYCTRGRQTFRAIWSGPPAVFDIWGQGTLVIVSSASTKG |
| 246 | LSSNEC14HC | NGGSLRLSCRVSGFGFHLYEMNWVRQAPGKGLEWISSISGSGES THYSDSITGRFSMSRDEAKDSLYLQMNNLRVEDTAVYYCTRGFS MGDTGFSFDTWGRGTMVTVSSGLDTVSLASTKGPSVFPLAPCS RSTSDARLS |
| 247 | LSSNEC16HC | AARLDQWGTGLVKPSETLSLKCAVFGVDFPDYTWTWARQAPGK GLEWIGHRDHRGGSSYNPSLSGRATISLDTSKAQFSLHIKSVTVAD TATYYCAGAVAGLWFEDAYNWFGPWSQGTLVTVAAASTKGPSVF PLAPSSKSTSGHASVL |
| 248 | LSSNEC21HC | QARLDQWGTGLLKPSETLSLKCAVFGVLFTDYNWTWVRQSPGKG LEWIGHLDHRGGGNYNPSLESRVTISLDYSKAQFSLHLKSVTVADT ALYYCAGAVKGLWFDETYTWFGPWSQGTRVTVASASTKGPSVFP LAPSSKSTSGTRDLS |
| 249 | LSSNEC30HC | QVQLVQSEAEVKKPGSSVKVSCKASGGTFRGYTISWVRQAPGQG LEWMGRIIPILGKAIYAPSFQGRVTLTADKSTGTAYMELSRLRSDD TAVYYCAKVKMRGSSGYYYLFDDWGQGTLVTVSSASTKG |
| 250 | LSSNEC49HC | QVHLVQSGAEVKKPGASVKVSCKVSGYTLSELSIHWVRQGPGRG LEWMANFDPEDGETIYAPQFQGRVTLTEDTSTDTAYMQLTSLRSE DTAVYYCATDRYTDTGRWGPGTLVTVSSASTKG |
| 251 | LSSNEC54HC | QARLDQWGTGLLKPSETLSLKCAVFGVLFTDYNWTWVRQSPGKG LEWIGHLDHRGGSYNPSLESRVSISLDYSKAQFSLHLKSVTVADT ALYYCAGAVKGFWFDEPSTWFGPWSQGTMVTVASASTKG |
| 252 | LSSNEC55HC | QARLDQWGTGLLKPSETLSLKCAVFGVLFTDYNWTWVRQSPGKG LEWIGHLDHRGGGNYNPSLESRVTISLDYSKAQFSLHLKSVTVADT ALYYCAGAVKGFWFDEVYNWFGPGVREPWLPSPQPPPRAHRSS PWHPPPRAPLVTATVP |
| 253 | LSSNEC57HC | QARLDQWGTGLLKPSETLSLKCAVFGVLFTDYNWTWVRQSPGKE LEWIGHLDHRGGGNYNPSLESRVTISLDYSKAQFSLHLKSVTVADT ARYYCAGAVKGFWFDDPYTWFGPWSQGTLVTVASASTKG |
| 254 | LSSNEC5HC | QVHLVQSGAEAKRPGSSVRVSCRASGGDFSSYTLSWVRQAPGQ GLERMGGVVPMLDTVHYAQKFQGRLTLSVDEGTSTAYMELSSLR SEDTAMYYCTRGRQTFRAIWSGPPVVFDIWGQGTLVSVSSASTKG |
| 255 | LSSNEC67HC | QFRLVQSGPEVKNPGSSVTVSCKASGGTFSGLGINWVRQAPGQG LEWLGDIKTMYGTTNYAPKFQGRVTITADESTSTSYMELSGLRSE DTAVFYCVRELFGHHPAFGVWGQGTSVIVSSASTKG |
| 256 | LSSNEC74HC | QVQLVQSGAEVKKPGASVKVSCKASGYTFTNYGVSWVRQAPGQ GLEWMGWISPYSGNTNYAQRLQDRVTMTTDTSTNTAYMELRSLR SDDTAVYYCAARSYYYYSMDVWGQGTTVTVSSASTKG |
| 257 | LSSNEC77HC | QVQLVQSGADVKKPGASVKVSCKVSGYTVSELSIHWVRQAPGKG LEWMGGFDPEDGKTVSAQNFQGRVTMTEDKSTGTANMELRSLR SEDTAVYYCATTVQLIVDFCNGGPCYNFDDWGQGTLVTVSSASTKG |
| 258 | LSSNEC85HC | QVQLVQSGAEVKKPGSSVKVSCKASGGTLSSYTISWVRQAPGQG LEWMGRLIPLVDITTYAQKFQGRVTITADTSTNTAYMELSNLRSED TAIYHCATSTMIAAVINDAFDLWGQGTTVTVSSASTKG |

TABLE A-continued

| Seq ID No. | Antibody | Heavy Chain Amino Acid Sequence |
|---|---|---|
| 259 | LSSNEC91HC | QVQLVQSGAEVKKPGASVKVSCKASGNTFTSYGITWVRQAPGQG LEWMGWISAYNGNTNYAQKLQDRLTMTTDTSTAYMELRSLRS DDTAVYYCAFSRHYGSGNYDYWGQGTLVTVSSASTKG |
| 260 | LSSNEC92HC | QVQLQQWGAGLLKPSETLSLTCAVYGGSFSGYYWSWIRQPPGK GLEWIGEINHSGSTNYNPSLKSRVTISVDTSKNQFSLKLSSVTAAD TAVYYCARLPIGSGWYGRDYWGQGTLVTVSSASTKG |
| 261 | 3A124HC | EVQLLESGGGLVRPGGSLXLSCSASGFTFNSYAMSWVRQAPGKG LEWVSSVSASGEMTYYADSVRGRFTISRDNANNALHLQMNSLRA EXTAVYYCAKVGGTVWSGYSNYLDYWGPGTLVTVSSASTKG |
| 262 | 3A125HC | QVQLVQSGAEVKKPGASVKVSCKPSSNTFTSHYIHWVRQAPGQG LEWMGMINPGGSTRYAPKFQGRVTLTRDTSTRTVYMELSSLRSE DTAVYYCARPQYNLGRDPLDVWGLGTMVTVSSASTKG |
| 263 | 3A140HC | EVQLVESGGGLVKPGGSLRLSCADSGFTFRSYSMHWVRQAPGK GLAWVSSISSTSNYIYYADSVKGRFTISRDNAKNSLYLQMNSLRAE DTAVYYCARTFITASWFDSWGQGTLVTVSSASTKG |
| 264 | 3A144HC | VSGGRFSNYGLSWVRQAPGQGLEWMGRIVPAINRAKYAQKFQG RVILTADKITDTAYMELRSLRSEDTAIFYCARDPQIE1RGNAFDIWG QGTVVTVSSASTKG |
| 265 | 3A160HC | QVQLQESGPGLVKPSGTLSLTCNVYGGSMISYYWSWIRQPPGKG LEWIGHVYNSGNTKYSPSLKNRVTISMDTSRNLFSLKVTSVTPADT AVYYCARADYDNIWDSRGGFDLWGQGTLVTVSSASTKG |
| 266 | 3A18HC | QVQLVQLLQSGAEVKKPGSSVKVSCQISGYGFSNYAISWVRQAP GQGLEWLGRIVPAVGMTEYAQKFQGRVTFTADRSTITAYMDLRGL RSDDTAVYYCVRDPQVEVRGNAFDIWGQGTMVTVSSASTKG |
| 267 | 3A204HC | QVQLVQSGAEMKKPGASVKVSCKASGHTFTNYYMHWVRQAPGQ GLEWMGMINPTGDSTRYAQRFQGRVTMTRDTSTRTVYMELSSLR SDDTAVYYCARAHHDFWRAPVDVWGKGTTVTVSSASTKG |
| 268 | 3A228HC | EVQLVQSGAEVKKPGESLRISCKTSGYNFNDDWIAWVRQRPDKG PEWMGIFYPGDSQATYSPSFQGHVTFSADTSISTAYLQWTSLKAS DTAIYYCARTRCFGANCFNFMDVWGKGTALTVTVSSASTKG |
| 269 | 3A233HC | QVQLQESGPGPVKPSETLSLTCTVSGGSMISYYWSWIRQPPGKG LEWIGYIFTNGRTTYSPSLRSRVTISLDTSNHFSLRLKSVTAADTAI YYCARLDGEAFRYYLDLWGQGNLVTVSSASTKG |
| 270 | 3A244HC | IRSFYWHWIRQSPGKGLEWLGSVFDNGLTTHNPSLKSRLTISEDP SRNQISLKLRSMTAADTAVYYCARGDYDILTSSYQFDYWGQGTLV AVSSASTKG |
| 271 | 3A255HC | QVQLQESGPGLVKPSETLSLTCTVFGASIRSFYWHWIRQSPGKGL EWLGSVFDNGLTTYNPSLKNRLSISEDPSRNQISLNLRSMTAADTA VYYCARADYDLLTSSYHFDSWGQGTLVTVSSASTKG |
| 272 | 3A296HC | QVQLQESGPGLVKPSETLSLTCTVSGGSISYYYWSWIRQPPGKGL EWIGDIYYSGTTDYNPSLKSRVTISVDTSKNQFSLKLSSVTAADTA VYYCARRGQRLLAYFDYWGQGSLVTVSSASTKG |
| 273 | 3A334HC | QVQLVQSGAEVKKPGASVKVSCKAPGYTFIGHYMHWIRQAPGQG LEWMGWINPNSGDTNYAQTFQGRVTMTRDTSISTAYMELTRLRS DDTAVYYCARDLRPMRGNWAMHVWGEGTTVTVSSASTKG |
| 274 | 3A366HC | CTVSGGSISSAGYYWTWIRQHPGKGLEFIGYIYYIGTTYYNPSLKS RLTISIDTSKNQFSLKLSSVTAADTAIYYCARDYTARGRHFFDYWG QGALVTVSSASTKG |
| 275 | 3A381HC | SSFAISWVRQAPGQGLEWMGGIIPIFEATSYAQKFQDRLTITTDES TTTAYMDLSSLRSEDTAVYYCARAQGDILTEGYFDYWGQGTLVTV SSASTKG |
| 276 | 3A384HC | QVQLVQSGAEVKKPGSSVKVSCKVSFFSNYGISWVRQRPGQGLE WMGRIIPAIDDMTYAQTFRGRVTFSADKFTTTAYMELTGLTFEDTA TYFCARDPQVNRRGNCFDHWGQGTLVTVSSASTKG |
| 277 | 3A419HC | LEWMGRIIPAIDDVTYAQTFRGRVTFSADKFTTTAYMDLTGLRSED TATYFCARDPQVNRRGNCFDHWGQGTLVTVSSASTKG |

TABLE A-continued

| Seq ID No. | Antibody | Heavy Chain Amino Acid Sequence |
|---|---|---|
| 278 | 3A461HC | QVQLVQSGAEVKKPGAAVKISCKASRFTFSSYYIHWVRQAPGQGL EWMGIINPSGGSTSNAQKFQDRVTLTRDMSTGTVYMELSRLTSED TAVYYCATPEPSSIVAPLYYWGQGTLVTVSSASTKG |
| 279 | 3A474HC | EVQLLESGGGLVQPGGSLRLSCAVSGFTFGGHAVSWVRQAPGK GLEWLSQISGTGSRTDYADAVKGRFTVSRDNSKKTVYLQMNSLR VEDTALFYCATRSPGGGYAFDIWGQGAMVTVSSASTKG |
| 280 | 3A518HC | QVQLQESGPGLVKPSETLSLTCTVSGGSISSAGYYWSWIRQHPEK GLEFIGYIYYLGTTYYNPSLKSRVSISIDTSNNQFSLELSSVSAADTA IYYCARDYTASGRHFFDYWGQGTLVTVSSASTKG |
| 281 | 3A539HC | EVQLLESGGALVQPGGSLRLSCAASGFTFSTSSMSWVRQAPGKG LEWVSAIGSGRGSTFYADSVKGRFTISRDNSKNTLSLQMNSLTAE DTATYYCTKTGGLLRFPEVWGKGTTVTVSSASTKG |
| 282 | 3A576HC | QVQLVQSGAEVKKPGSSVKVSCKASGGTFSNYAISWVRQAPGQG LEWMGGIIPIFEAASYAQKFQDRLTITTDESTTTAYMDLSSLRSEDT AIYYCARAQGDILTEGYFDYWGQGTLVTVSSASTKG |
| 283 | 3A613HC | QVQLQESGPGLVKPSETLSLTCTVSGGSISTYYWSWIRQPPGKGL EWIGYISYSGSTNYNPSLKSRVTISVDTSKNQFSLKLSSVTAADTA VYYCARHKSVLLWFRELDYWGQGTLVTVSSASTKG |
| 284 | 3A64HC | QVQLVQSGAEVKKPGSSVKVSCKTSGVRFSSNAISWVRQAPGQG LEWMGRTTPMLGGANHAPSFKGRVTISADESTRTVYMEMSSLRY EDTAVYYCASGRREGLNFLLDYWGQGTLVTVSSASTKG |
| 285 | 3A650HC | QVQLVQSGAEVRKPGASVKVSCKTSGYTFTNSYIHWVRQAPGQG LEWMGIINPGGNTYYAQKFHGRVTLTRDTSTSTVYMELNSLRSE DTAVYFCARPHSPTNIPSRPLDYWGQGTLVTVSSASTKG |
| 286 | 3A67HC | QVQLVQSGAEVKKPGASVKVSCKVSGYPLAELSVHWVRQVPGK GLEWVGGFDPEEGKTVYAQKFQGRVTMTEDRSTDTVYMELISLR YEDTAVYYCATDNPVLQLGELSSSLDYWGQGTLVTVSSASTKG |
| 287 | 3A779HC | PSETLSLTCRVSGASISNFYWTWIRQPAGKGLEWIGRLYSSDKTN YNPSLNGRVTMSLDTSKNQFSLRLTSMTDADTAIYYCAREKGQW VTLPPYYFDSWGQGILVTVSSASTKG |
| 288 | 3A816HC | NTFTSHYVHWVRQAPGQGLEWMGMINPGGTTRYAPKFQDRVTL TRDTSTRTVYMELRSLRSEDTAVYYCARPQYNLGREPLNVWGQG TMVTVSSASTKG |
| 289 | 3A869HC | QVQLQESGPGLVKPSETLSLTCSVSGASISNFYWTWIRQPAGKGL EWVGRLYSSDRTNYNPSLNGRVTMSLDTSKNQFSLRLTSMTDAD TAIYFCAREKGQWLTVPPYYFDSWGQGILVTVSSASTKG |
| 290 | 3A93HC | CTVSGGSIISYYWNWIRQSPGKGLEWLGYIFDGGRANYNPSLRSR LTMSVDTSKNQISLKVKSVTAADSAIYYCARLDGEAFRYYFDSWG QGTLVTVSSASTKG |
| 291 | 3A966HC | QTLSLTCSVSGGSISSAGYYWGWIRQHPGKGLEWIGHIYYSGNTN YNPSLKSRLSMSVETSKNQFSLNLASVTAADTAVYFCARDYSAAG RHLFDSWGQGILVTVSSASTKG |
| 292 | 3A978HC | KPSQTLSLTCTVSGGSISSAGYYWTWIRHHPGKGLEFIGYIYHIGT PYYNPSLKSRLTISIDTSKNQFSLKLSSVTAADTAIYYCARDYTARG RHFFDYWGQGALVTVSSASTKG |
| 293 | 3ANC3HC | QVQLVQSGADVKKPGASVTVSCKTDEDEDDFRAHLVQWMRQAP GQRLEWVGWIKPQTGQPSYAQKFQGRVTLTREVSTSTVFLQLRN LRSDDTAVYYCARPRGGRDNWSFHVWGRGTLVTVSSASTKG |
| 294 | 3ANC42HC | QVQLVQSGAAVKKPGASVKVSCETYGYTFTDHFMHWWRQAPGQ GLEWMGWINPYSSAVSYSPRYQGRVTMTRDTFLETVYMELRGLK FDDTAIYYCATPKSGRDYWSFDLWGQGTLVTVSSASTKG |
| 295 | 3ANC66HC | QVQLVQSGAAVKKPGASVKVSCETYGYKFTDHFMHWWRQAPGQ GLEWMGWINPYSSAVSYSPRYQGRVTMTRDTFLETVYMELRGLR FDDTAIYYCATPKSGRDYWSFDLWGQGTLVTVSSASTKG |
| 296 | 3ANC79HC | QVQLVQSGAAVKKPGASVKVSCEAYGYKFTDHFMHWWRQAPGQ GLEWMGWINPYTSAVNYSPKYQGRVTMTRDTFLETVYMELRGLR VDDTAIYYCATPKSGRDYWSFDLWGQGTLVTVSSASTKG |

TABLE A-continued

| Seq ID No. | Antibody | Heavy Chain Amino Acid Sequence |
|---|---|---|
| 297 | 3B10HC | QVQLQESGPGLVKPSETLSLTCSVSNGSISSGGYYWSWLRQFPG KGLEWIGSIHYTGRTMYNPSLMGRPALSMDTSNNQFSLKLRSVTA ADTALYFCARDLQWIFVVDPWGQGTLVTVSSASTKG |
| 298 | 3B120HC | LQQLQVPRLSMWRVFKVAAATGAQTLTVEEPGSSVKVSCKASGG SSTAYGYSWVRQAPGQGFEWMGRIIPFYGIITYAPKFQGRVTITAD RSTSTVYMELTSLTFADTALFFCARDFGDPRNGYYFDSWDQGLW LTVSSASTKG |
| 299 | 3B126HC | QVHLVQSGAEVKKPGSSVRVSCKASGWTFGDSVNSAITWVRQAP GQGLEWMGRFIPILGLSNYAQKFQDRVTINVDRSTNTAYMELSGL RSEDTAVYYCARLITGMNAPWFYYMDVWGKGTTITVSSASTKG |
| 300 | 3B129HC | FICFSVVVRLLEFGGRLVQPGGSLRLSCSASGFTFSNSAMSWVRQ APGKGLEWVSSILSSGVGTFYADSVKGRFTVSRDNSRNTLYLQMK SLRAEDTALYYCAKVQIQQLNFGVITDAGLDVWGKGTTLIVSSAST KG |
| 301 | 3B142HC | QVQLGQSGTEVKKPGFSVKVSCKASGGSSTAYGYSWVRQAPGQ GFEWMGRIIPFYGIITYAPKFQGRVTITADRSTSTVYMELTSLTFAD TALFFCARDFGDPRNGYYFDSWDQGLWLTVSSASTKG |
| 302 | 3B154HC | QVQLVQSGGEVRKPGSSVKVPCKISGNAFSNYGVNWVRQAPGQ GLEWVGRIIPVIGVAQHAPKFQGRVTITADKSTTTAYLELSSLRSDD TAVYFCAKDHGDPRTGYYFDYWGQGALVTVSSASTKG |
| 303 | 3B165HC | QVQLLQSGTEVKKPGSSVKVSCRASGWTLGNSPNSAIGWVRQAP GQGLEWIGRIIPILDVTNYAQKFQGRVTISADKSTNIAYMEISSLGSE DTAFYYCARVITGMTSPWYFYMDVWGEGTTVIVSSASTKG |
| 304 | 3B171HC | VQSQVYLVQSGGEVKKPGSSVKVSCKASGDSFSSSVITWVRQAP GQGPEWMGRIIPVLGVAAYAQNFYGRVTISADTSSNTAYMELSSL RFEDTAVFYCARETGRGGNLALRQYFFDSWGQGTLVTVSSPSTKG |
| 305 | 3B17HC | EVQLVESGGGLVQPGGSLRISCSATGFTFSTHAMHWVRQAPGKG LEYVSAINSNGRSAFYADSVKGRVTISRDNSKNTLFLQMTSLRAED TAVYYCVKGPLLRYLDSWGQGTLVTVSSASTKG |
| 306 | 3B186HC | QVQLVESGGGLVKPGGSLRLSCAASGFSFNEYYMSWIRQAPGQG LEWVANIGSSDAYTIYADSVKGRFTISRDNAENTVYLQMNSLRGE DTAVYYCARIEGYCSNSRCSNYFDPWGQGALVTVSSASTKG |
| 307 | 3B193HC | MFLFLVAGATGVQSQVYLVPFGPEVKKPGSSVKVSCKASGDSFTS SVITWVRQAPGQGPEWMGRVIPVLGVAAYAQKFYGRVTITADTSS NTAYMEVNSLRFEDTAVYYCARETGRGGNLALRQYFFDSWGQGT LVTVSSPSTKG |
| 308 | 3B22HC | CQVQLVESGGGVVQPGRSLRLSCVGSGFTFSSSGMHWVRQAPG KGLEWVAVISSDGSDEYYGDSVEGRFTISRDNSKNTLFLQLDSLE AEDSAVYYCAKTPPHYDALTGYPSSVLEFWGLGTLVTVSSASTKG |
| 309 | 3B27HC | EVQLVESGGGLVQPGGSLRISCSATGFTFSTHAMHWVRQAPGKG LEYVSAINSNGRSAFYADSVKGRVTISRDNSKNTLFLQMTSLRAED TAVYYCVKGPLLRYLDSWGQGTLVTVSSASTKG |
| 310 | 3B29HC | QVHLVQSGAEVKKPGSSVRVSCKASGWTFGDSVNSAITWVRQAP GQGLEWMGRFIPILGLSNYAQKFQDRVTINVDRSTNTAYMELSGL RSEDTAVYYCARLITGMNAPWFYYMDVWGKGTTITVSSASTKG |
| 311 | 3B2HC | SGGRLVQPGGSLRLSCSASGFTLSNSAMSWVRQAPGKGLEWVS SILSSGVGTFYADSVKGRFTSRDNSRNTLYLQMKSLRAEDTALY YCAKVQIQQLNFGVITDAGLDVWGKGTTLIVSSASTKG |
| 312 | 3B31HC | EVQLVQSGAEVKKPGSSVKVSCKASGGTFTTYDISWVRQAPGQG LEWIGGILPDFGAPSYAQKFQDRVTITTDESSRTAYMELNSLRSED TAIYYCARGRGDDFWSGESPSWYFDYWGQGTQVTVSSASTKG |
| 313 | 3B33HC | PLVQLEPSGVEVKKRGASVKVSCKVSGYSLTELSMHWVRQAPGK GLEWMGSFDPLDGDTIYAQKFQGRVTMTVDTSTDTAYMDLSSLR FEDTAVYYCATPSKAYYYDSPNYEGDFYMDVWGKGTTVIVSSAST KG |
| 314 | 3B40HC | QVQLVESGGGVVQPGRSLRLSCVGSGFTFSSSGMHWVRQAPGK GLEWVAVISSDGSDEYYGDSVEGRFTISRDNSKNTLFLQLDSLEA EDSAVYYCAKTPPHYDALTGYPSSVLEFWGLGTLVTVSSASTKG |

TABLE A-continued

| Seq ID No. | Antibody | Heavy Chain Amino Acid Sequence |
|---|---|---|
| 315 | 3B41HC | EVQLVQSGAEVKKPGASVKVSCKVSGYTLTELSMHWVRQAPGKG LEWMGVFDPLEGDGVYAEKFRGRVIMTEDTSTDTGYMELTSLRS EDTAIYYCATKAKDYYYESSDYSPYYYYYMDVWGKGTTVTVSSAS TKG |
| 316 | 3B44HC | EVRLLESGGGLVQPGGSLRLSCSASGFTFSNSALSWVRQAPGKG LEWVSSVVSSGGDTFYADSVKGRFTISRDNSRNTLYLQMKSLRAE DTALYYCAKVQIQQLNFGVITDAGMDVWGKGTTVIVSSASTKG |
| 317 | 3B45HC | VEEPGSSVKVSCKASGGSSTAYGYSWVRQAPGQGFEWMGRIIPF YGIITYAPKFQGRVTITADRSTSTVYMELTRLTFADTALFFCARDYG DPRNGYYFDSWDQGLWLTVSSASTKG |
| 318 | 3B48HC | QVQLVESGGGLVQPGGSLRISCSATGFTFSTHAMHWVRQAPGKG LEYVSAINSNGRSAFYADSVKGRVTISRDNSKNTLFLQMTSLRAED TAVYYCVKGPLLRYLDSWGQGTLVTVSSASTKG |
| 319 | 3B50HC | QVQLVQSGPGLVKPSETLSLTCSVSNGSISSGGYYWSWLRQFPG KGLEWIGSIHYTGRTFYNPSLMGRTALSMDTSNNQFSLKVSSVTA ADTALYYCARELQWMFVVDPWGQGTLVTVSSASTKG |
| 320 | 3B51HC | QVQLLQSGTEVKKPGSSVKVSCRASGWTLGNSPNSAIGWVRQAP GQGLEWIGRIIPILDVTNYAQKFQGRVTISADKSTNIAYMEISSLGSE DTAFYYCARVITGMTSPWYFYMDVWGEGTTVIVSSASTKG |
| 321 | 3B56HC | QVQLVQSGGEVKKPGASVKVSCKVSGYSLTELSMHWVRQAPGK GLEWMGVFDPLEGDGVYVQKFRGRVIMTEDTSTDTAYMELTSLR SEDTAIYYCATKAKDYYYESSDYSPYYYYYMDVWGKGTTVTVSSA STKG |
| 322 | 3B57HC | GSEVQLVESGAEVKKRGASVKVSCKVSGYSLTELSMHWVRQAPG KGLEWMGSFDPLDGDTIYAQKFQGRVTMTVDTSTDTAYMDLSSL RFEDTAVYYCATPSKAYYYDSPNYEGDFYMDVWGKGTTVIVSSA STKG |
| 323 | 3B5HC | SVVQLVESGPGLVKPSETLSLTCSVSNGSISSGGYYWSWLRQFP GKGLEWIGSIHYTGRTMYNPSLMGRPALSMDTSNNQFSLKLRSVT AADTALYFCARDLQWIFVVDPWGQGTLVTVSSASTKG |
| 324 | 3B61HC | SVDERLLEFGGRLVQPGGSLRLSCSASGFTFSNSAMSWVRQAPG KGLEWVSSILSSGVGTFYADSVKGRFTVSRDNSRNTLYLQMKSLR AEDTALYYCAKVQIQQLNFGVITDAGLDVWGKGTTLIVSSASTKG |
| 325 | 3B6HC | QLQLKESGPGMVKPSETLSLTCSVSGASVVSANDYWGWIRQAPG KGLECIGIILYTGSTFYNPSLQSRVTISRDPSKNHVSLTLTSVTAADS AVYYCARIPYHSESYYNVVIGGFDVWGQGTRVTVSSASTKG |
| 326 | 3B77HC | QVHLVQSGAEVKKPGSSVRVSCKASGWTFGDSVNSAITWVRQAP GQGLEWMGRFIPILGLSNYAQKFQDRVTINVDRSTNTAYMELSGL RSEDTAVYYCARLITGMNAPWFYYMDVWGKGTTITVSSASTKG |
| 327 | 3B79HC | QVQLGQSGTEVKKPGFSVKVSCKASGGSSTAYGYSWVRQAPGQ GFEWMGRIIPFYGIITYAPKFQGRVTITADRSTSTVYMELTSLTFAD TALFFCARDFGDPRNGYYFDSWDQGLWLTVSSASTKG |
| 328 | 3B84HC | SQVQLVESGPGLVKPSETLSLTCSVSNGSISSGGYYWSWLRQFP GKGLEWIGSIHYTGRTMYNPSLMGRPALSMDTSNNQFSLKLSSVT AADTALYFCARDLQWIFVVDPWGQGTLVTVSSASTKG |
| 329 | 3B86HC | RVHSQVQLVESGPGLVKPSQTLSLTCTVSGGSISNGGHYWNWIR QHPGKGLEWIGHIYNIATTYYNPSLKSRVSISVDTSKNQFSLKLSSV TAADTAVYYCARGSGRWTIGARIYFDNWGQGALVAVSSASTKG |
| 330 | 3B8HC | QVQLVQSGGEVRKPGSSVKVPCKISGNAFSNYGVNWVRQAPGQ GLEWVGRIIPVIGVAQHAPKFQGRVTITADKSTTTAYLELSSLRSDD TAVYFCAKDHGDPRTGYYFDYWGQGALVTVSSASTKG |
| 331 | 3B93HC | QVHLVQSGAEVKKPGSSVRVSCEASGWTFGSVNSAITWVRQAPG QGLEWMGRTIPFLGISNYAQKFQGRVTITADKSTNIAYVDVTSLTS QDTAVYYCARLITGMTAPWFYYMDVWGKGTTVTVSSASTKG |
| 332 | 3BNC101HC | EVQLVQSGSDVKKPGTTVTISCKADEDEDDFTAYNYFMHWVRQA PGQGLEWIGWINPRTGQPNHAKQLQGRVTLTRERSTSTVFMKLT NLRLDDTAVYFCARPLRGGDTWHYHSWGRGTSLIVSSASTKG |

TABLE A-continued

| Seq ID No. | Antibody | Heavy Chain Amino Acid Sequence |
|---|---|---|
| 333 | 3BNC124HC | QSQVHLVQSGAEVKKPGSSVKVSCQASGGTFNTFAINWVRQAPG QGLEWVGGIIPVFGTASYAQKFQGRVTVTTDESRGTAYMELNSLR SEDTAVYYCARGQTDLNDDLWSDYSTPGFDYWGQGTLVTVSSAS TKG |
| 334 | 3BNC130HC | RVQLGQSGAEVKKPGASVKVSCKVSGNSLTEFSIHWVRQAPGKG LEWMGGFDPEEGETVPAQKFKGRVTMTEDTSTNTAYMELSSLRS EDTAVYYCSTEPREMGTLTAGFEYWGQGTLVIVSSASTKG |
| 335 | 3BNC149HC | QPQLVQSGSGAEVKKPGASVRISCEASEYNVFDHFMQWVRQAP MEGLEWMGWINPRGGYPSYSPTFQGRLTFTRQPSWDDSTITFHM ELRGLRHDDTAVYYCARPHSPDDAWSLDVWGRGTLVTVSSASTKG |
| 336 | 3BNC177HC | LQPRVHSEVQLVESGAEVKKPGASVKVSCKVSGYTLSDLSMHWV RQAPGKGLEWMGGFDEEDGEITYAQKFQGRVSMTEDTSRDTAY MELSSLRSEDTAVYYCATAPRLELGELSSGFHYWGLGTLVTVSSA STKG |
| 337 | 3BNC17HC | RVQLGQSGAEVKKPGASVKVSCKVSGNSLTEFSIHWVRQAPGKG LEWMGGFDPEEGETVPAQKFKGRVTMTEDTSTNTAYMELSSLRS EDTAVYYCSTEPREMGTLTAGFEYWGQGTLVIVSSASTKG |
| 338 | 3BNC48HC | IWAPLIAVTFLVLHCESLGTCCCCQASGGTFNTFAINWVRQAPGQ GLEWVGGIIPVFGTASYAQKFQGRVTVTTDESRGTAYMELNSLRS EDTAVYYCARGQTDLNDDLWSDYSTPGFDYWGQGTLVTVSSAST KG |
| 339 | 3BNC58HC | EVQLVESGAEVKKPGASVKVSCKVSGYTLSDLSMHWVRQAPGKG LEWMGGFDEEDGEITYAQKFQGRVSMTEDTSRDTAYMELSSLRS EDTAVYYCATAPRLELGELSSGFHYWGLGTLVTVSSASTKG |
| 340 | 3BNC78HC | EVQLVESGAEVKKPGASVKVACKVSGKKLSDLSIHWVRQAPGKG LEWMGGFDEEDGKISYERKFQGRVTMTEDTARDTAFMEMSSLRS DDTAVYFCAAAPRLDLGELSSGFHFWGLGTLVSVSSASTKG |
| 341 | 3BNC82HC | CNPRVHSEVQLVESGAEVKKPGASVKVACKVSGKKLSDLSIHWV RQAPGKGLEWMGGFDEEDGKISYERKFQGRVSMTEDTARDTAF MEMSSLRSDDTAVYFCAAAPRLDLGELSSGFHFWGLGTLVTVSS ASTKG |
| 342 | 3BNC8HC | EVQLVESGAEVKKPGASVKVSCKVSGNSLTEFSIHWVRQAPGKG LEWMGGFDPEEGETVPAQKFKGRLTMTEDTSTNTAYMELSSLRS EDTAVYYCSTEPREMGTLTAGFEYWGQGTLVTVSSASTKG |
| 343 | 3a426hc | QVQLQESGPGLVKPSETXSLTCSVSNGSISSGGYYWSWLRQFPG KGLEWIGSIHYTGRTMYNPSLMGRPALSMDTSNNQFSLKLSSVTA ADTALYFCARDLQWIFVVDPWGQGTLVTVSSASTKG |
| 344 | 3a515hc | QVQLVQSGAEVKKPGSSVKVSCKASGGTFTTYDISWVRQAPGQG LEWMGGILPDFGAPSYAQKFQDRVTITTDESSSTAYMELNSLRSE DTAIYYCARGRGDDFWSGESPSWYFDYWGQGTLVTVSSASTKG |
| 345 | 3b46HC | GYSEVQLVQSGPGLVKPSQTLSLTCTVSGGSISNGGHYWNWIRQ HPGKGLEWIGHIYNIATTYYNPSLKSRVSISVDTSKNQFSLKLSSVT AADTAVYYCARGSGRWTIGARIYFDNWGQGALVAVSSASTKG |
| 346 | 3ANC32HC | QVQLVQSGADVKKPGATVTVSCKTDEDEDDFRAHLMQWMRQAP GQRLEWVGWIKPQTGQPSYGQKFQGRVTLTREVSTSTVFLQLRN LRSDDTAVYYCARPRGGRDNWSFHVWGRGTLVTVSSASTKG |
| 347 | 3ANC3HC | QVQLVQSGADVKKPGASVTVSCKTDEDEDDFRAHLVQWMRQAP GQRLEWVGWIKPQTGQPSYAQKFQGRVTLTREVSTSTVFLQLRN LRSDDTAVYYCARPRGGRDNWSFHVWGRGTLVTVSSASTKG |
| 348 | 3ANC41HC | QVQLVQSGAAVKKPGASVKVSCETYGYTFTDHFMHWWRQAPGQ GLEWMGWINPYSSAVSYSPRYQGRVTMTRDTFLETVYMELRGLK FDDTAIYYCATPKSGRDYWSFDLWGQGTLVTVSSASTKG |
| 349 | 3ANC42HC | QVQLVQSGAAVKKPGASVKVSCETYGYTFTDHFMHWWRQAPGQ GLEWMGWINPYSSAVSYSPRYQGRVTMTRDTFLETVYMELRGLK FDDTAIYYCATPKSGRDYWSFDLWGQGTLVTVSSASTKG |
| 350 | 3ANC66HC | QVQLVQSGAAVKKPGASVKVSCETYGYKFTDHFMHWWRQAPGQ GLEWMGWINPYSSAVSYSPRYQGRVTMTRDTFLETVYMELRGLR FDDTAIYYCATPKSGRDYWSFDLWGQGTLVTVSSASTKG |

TABLE A-continued

| Seq ID No. | Antibody | Heavy Chain Amino Acid Sequence |
|---|---|---|
| 351 | 3ANC70HC | QVQLVQSGAAVKKPGASVKVSCETYGYKFTDHFMHWWRQAPGQGLEWMGWINPYSSAVSYSPRYQGRVTMTRDTFLETVYMELRGLRFDDTAIYYCATPKSGRDYWSFDLWGQGTLVTVSSASTKG |
| 352 | 3ANC75HC | QVQLVQSGAAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG |
| 353 | 3ANC79HC | QVQLVQSGAAVKKPGASVKVSCEAYGYKFTDHFMHWWRQAPGQGLEWMGWINPYTSAVNYSPKYQGRVTMTRDTFLETVYMELRGLRVDDTAIYYCATPKSGRDYWSFDLWGQGTLVTVSSASTKG |
| 354 | 3ANC87HC | QVQLVQSGGAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG |
| 355 | 3ANC8HC | QVQLVQSGADVKKPGASVTVSCKTDEDEDDFRAHLVQWMRQAPGQRLEWVGWIKPQTGQPSYAQKFQGRVTLTREVSTSTVFLQLRNLRSDDTAVYYCARPRGGRDNWSFHVWGRGTLVTVSSASTKG |
| 356 | 3ANC96HC | QVQLVQSGADVKKPGASVTVSCKTDEDEDDFRAHLVQWMRQAPGQRLEWVGWIKPQTGQPSYAQKFQGRVTLTREVSTSTVFLQLRNLRSDDTAVYYCARPRGGRDNWSFHVWGRGTLVTVSSASTKG |
| 357 | 3B106HC | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVIVSSASTKG |
| 358 | 3B16HC | QVQLLQSGAAVTKPGASVRVSCEASGYNIRDYFIHWWRQAPGQGLQWVGWINPKTGQPNNPCQFQGRVSLTRHASWDFDTFSFYMDLKALRSDDTAVYFCARQRSDYWDFDVWGSGTQVTVSSASTK |
| 359 | 3B180HC | QVQLLQSGAAVTKPGASVRVSCEASGYNIRDYFIHWWRQAPGQGLQWVGWINPKTGQPNNPCQFQGRVSLTRQASWDFDTISFYMDLKALRLDDTAVYFCARQRSDYWDFDVWGSGTQVTVSSASTKG |
| 360 | 3B183HC | QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGSQVTVSSASTKG |
| 361 | 3B191HC | QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGTQVTVSSASTKG |
| 362 | 3B21HC | QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGTQVTVSSASTKG |
| 363 | 3BBM60 | QVHLSQSGAAVTKPGASVRVSCEASGYKISDHFIHWWRQAPGQGPQWVGWINPKTGQPNNPRQFQGRISLTRQASWDFDTFSFYMDLKALRSDDTAVYFCARHRSDYWDFDVWGSGTQVTVSSASTKG |
| 364 | 3BBM60 | QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYRDFDVWGSGTQVTVSSASTKG |
| 365 | 3BBM60 | QVHLSQSGAAVTKPGASVRVSCEASGYKIRDYSIHWWRQAPGQGLQWVGWINPQTGQPNIPRPFQGRISLTRQASWDFDTFSFYMDLEALRSDDTAVYFCARQRSDYWDFDVWGSGTQVTVSSASTKG |
| 366 | 3BBM60 | QVHLSQSGAVVTKPGASVRVSCEASGYKISDHFIHWWRQAPGQGLQWVGWINPKTGQPNNPRQFQGRISLTRQASWDFDTFSFYMDLEALRSDDTAVYFCARQRSDYWDFDVWGSGTQVTVSSASTKG |
| 367 | 3BBM60 | QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG |
| 368 | 3BBM60 | QVHLSQSGAAVTKPGASVRVSCEASGYKISDHFIHWWRQAPGQGLQWVGWINPKTGQPNNPRQFQGRVSLTRQASWDFDTYSFYMGLKAVRSDDTAIYFCARQRSDFWDFDVWGSGTQVTVSSASTKG |
| 369 | 3BBM60 | QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG |

TABLE A-continued

| Seq ID No. | Antibody | Heavy Chain Amino Acid Sequence |
|---|---|---|
| 370 | 3BBM60 | QVHLSQSGAVVTKPGASVRVSCEASGYKISGHFIHWWRQAPGQG LQWVGWINPKTGQPNNPRQFQGRISLTRQASWDFDTFSFYMDLK ALRSDDTAVYFCARHRSDYWDFDVWGSGTQVTVSSASTKG |
| 371 | 3BBM60 | QVHLSQSGAVVTKPGASVRVSCEASGYKISDHFIHWWRQAPGQG LQWVGWINPKTGQPNIPRQFQGRISLTRQASGDFDTFSFYMDLKA LRSDDTAVYFCARQRSDYWDFGVWGSGTQVTVSSASTKG |
| 372 | 3BBM60 | QVHLSQSGAVVTKPGASVRVSCEASGYKISDHFIHWWRQAPGQG LQWVGWINPKTGQPNNPRQFQGRISLTRQASWDIDTFSFYMDLK ALRSDDTAVYFCARHRSDYWDFDVWGSGTQVTVSSASTKG |
| 373 | 3BBM60 | QVHLSQSGAVVTKPGASVRVSCEASGYKISDHFIHWWRQAPGQG LQWVGWINPKTGQPNNPRQFQGRISLTRQASWDFDTFSFYMDLK ALRSDDTAVYFCARQRSDYWDFDVWGSGTQVTVSSASTKG |
| 374 | 3BBM60 | QVHLSHSGAAVTKPGASVRVSCEASGYKISDHFIHWWRQAPGQG LQWVGWINPKTGQPNNPRQFQGRISLTRQASWDFDTFSFYMDLK ALRSDDTAVYFCARQRSDYWDFDVWGSGTQVTVSSASTKG |
| 375 | 3BBM60 | QVHLSQSGAVVTKPGASVRVSCEASGYKISDHFIHWWRQAPGQG LQWVGWINPKTGQPNNPRQFQGRISLTRQASWDFDTFSFYMDLK ALRSDDTAVYFCARHRSDYWDFDVWGSGTQVTVSSASTKG |
| 376 | 3BBM60 | QVHLSQSGAVVTKPGASVRVSCEASGYKISDHFIHWWRQAPGQG LQWVGWINPKTGQPNNPRQFQGRISLTRQASWDFDTFSFYMDLK ALRSDDTAVYFCARHRSDYWDFDVWGSGTQVTVSSASTKG |
| 377 | 3BBM60 | QVHLSQSGAAVTKPGASVRVSCEASGYKISDHFIHWWRQAPGQG LQWVGWINPKTGQPNNPRQFQGRISLTRQASWDFDTFSFYMDLK ALRSDDTAVYFCARHRSDYWDFDVWGSGTQVTVSSASTKG |
| 378 | 3BNC101HC | EVQLVQSGSDVKKPGTTVTISCKADEDEDDFTAYNYFMHWVRQA PGQGLEWIGWINPRTGQPNHAKQLQGRVTLTRERSTSTVFMKLT NLRLDDTAVYFCARPLRGGDTWHYHSWGRGTSLIVSSASTKG |
| 379 | 3BNC102HC | QPQLVQSGSGAEVKKPGASVRISCEASEYNVFDHFMQWVRQAP GQGLEWMGWINPRGGYPSYSPRFQGRLTFTRQPSWDDSSVTFH MELRGLRHDDTAVYYCARPHSPDDAWSLDVWGRGTLVTVSSAST KG |
| 380 | 3BNC104HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 381 | 3BNC105HC | HVQLLQSGAAVTKPGASVRVSCEASGYNIRDYFIHWWRQAPGQG LQWVGWINPKTGQPNNPRQFQGRVSLTRQASWDFDTFSFYMDL KALRLDDTAIYFCARQRSDYWDFDVWGSGTQVTVSSASTKG |
| 382 | 3BNC106HC | VVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 383 | 3BNC107HC | QVQLVQSGAALKKPGASLRISCQAYGYKFTDYLIHWWRQAPGQG LEWIGWIKPETGQPSYSYKFQGRVSLTRDTFEEILFMDLRGLRSD DTAIYFCARRHSDYCDFDVWGGGSQVLVSSASTKG |
| 384 | 3BNC108HC | QVQLVQSGTAVKKPGASVRVSCQASGYTFTDYFIYWWRQAPGQ GLEWLGWINPRTSQPSYPYRFQGRVTLTRDIFEEMLYMDLRGLRS DDTGIYFCARRHSDYCDFDIWGSGTQIIVSSASTKG |
| 385 | 3BNC10HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 386 | 3BNC114HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 387 | 3BNC117HC | QVQLLQSGAAVTKPGASVRVSCEASGYNIRDYFIHWWRQAPGQG LQWVGWINPKTGQPNNPRQFQGRVSLTRHASWDFDTFSFYMDL KALRSDDTAVYFCARQRSDYWDFDVWGSGTQVTVSSASTKG |
| 388 | 3BNC126HC | QPQLVQSGSGAEVKKPGASVRISCEASEYNVFDHFMQWVRQAP GQGLEWMGWINPRGGYPSYSPTFQGRLTFTRQPSWDDSTITFH |

TABLE A-continued

| Seq ID No. | Antibody | Heavy Chain Amino Acid Sequence |
|---|---|---|
| | | MELRGLGHDDTAVYYCARPHSPDDAWSLDVWGRGTLVTVSSAS TKG |
| 389 | 3BNC127HC | EVQLVESGSDVRKPGATVTVSCKADEDEDDFTAYNYFMHWVRQA PGQGLEWIGWINPRTGQPNHAKQFQGRVTLTRERSTSTVFMKLT NLRLDDTAVYFCARPLRGGDTWHYHSWGRGTSLTVSSASTKG |
| 390 | 3BNC134HC | QVQLVQSGAALKKPGASLRISCQAYGYKFTDHLIYWWRQAPGQG LEWIGWIKPETGQPSYSYKFQGRVSLTRDTFQEILFMNLRGLRSD DTAIYFCARRHSDYCDFDVWGSGSQILVSSASTKG |
| 391 | 3BNC140HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 392 | 3BNC141HC | VVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 393 | 3BNC142HC | QVQLVQSGAALKKPGASVRISCQAYGYKFTDHLIYWWRQAPGQG LEWIGWIKPETGQPSYSYKFQGRVTLTRDTFEEIHFMDLRGLRYD DTATYFCARRHSDYCDFDVWGSGSQVSVSSASTKG |
| 394 | 3BNC148HC | QVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSRGRGTSLTVSSASTKG |
| 395 | 3BNC149HC | QPQLVQSGSGAEVKKPGASVRISCEASEYNVFDHFMQWVRQAP MEGLEWMGWINPRGGYPSYSPTFQGRLTFTRQPSWDDSTITFHM ELRGLRHDDTAVYYCARPHSPDDAWSLDVWGRGTLVTVSSASTKG |
| 396 | 3BNC151HC | QVQLVQSGATLKKPGASVRISCQAYGYKFTDHLIHWWRQAPGQG LEWIGWIKPETGQPSYAYKFQGRVSLTRDTFEEILFMDLRGLRSD DTAIYFCARRHSDYCDLDVWGGGTQLLVSSASTKG |
| 397 | 3BNC153HC | QVQLVQSGAALKKPGASLRISCLTYGYKFTDHLIYWWRQAPGQGL EWIGWIKPETGQPSYSYRFQGRVSLTRDTFEEIVFMDLRGLRSDD TAIYFCARRHSDYCDFDVWGSGSQVIVSSASTKG |
| 398 | 3BNC156HC | QVQLVQSGAALKKPGASLRISCQTYGYKFTDHLIYWWRQAPGQG LEWIGWIKPETGQPSYSYRFQGRVSLTRDTFEEIVFMDLRGLRSD DTAIYFCARRHSDYCDFDVWGGGSQVIVSSASTKG |
| 399 | 3BNC158HC | QVQLVQSGAALKKPGASLRISCQTYGYKFTDHLIYWWRQAPGQG LEWIGWIKPETGQPSYSYRFQGRVSLTRDTFEEIVFMDLRGLRSD DTAIYFCARRHSDYCDFDVWGSGSQVIVSSASTKG |
| 400 | 3BNC159HC | QVQLVQSGAALKKPGASVRISCQTYGYKFTDHLIHWWRQAPGQG LEWIGWIKPDTGQPSYSSRFQGRVSLTRDTFEEIVFMDLRGLRSD DTAIYFCARRHSDYCDFDVWGSGSQVLVSSASTKG |
| 401 | 3BNC15HC | QVQLVQSGAALKKPGASLRISCQTYGYKFTDHLIYWWRQAPGQG LEWIGWIKPETGQPSYSYRFQGRVSLTRDTFEEIVFMDLRGLRSD DTAIYFCARRHSDYCDFDVWGSGSQVLVSSASTKG |
| 402 | 3BNC173HC | QVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 403 | 3BNC175HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 404 | 3BNC176HC | QVQLLQSGAAVTKPGASVRVSCEASGYNIRDYFIHWWRQAPGQG LQWVGWINPKTGQPNNPRQFQGRVSLTRHASWDFDTFSFYMDL KGLRSDDTAIYFCARQRSDYWDFDVWGSGTQVTVSSASTKG |
| 405 | 3BNC181HC | EVQLVQSGSDVRKPGATVTVSCKADEDEDDFTAYDYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 406 | 3BNC186HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |

TABLE A-continued

| Seq ID No. | Antibody | Heavy Chain Amino Acid Sequence |
|---|---|---|
| 407 | 3BNC18HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 408 | 3BNC193HC | QVQLVQSGTAVKKPGASVRVSCQASGYTFTDYFIYWWRQAPGQ GLEWLGWINPRTSQPSYPYRFQGRVTLTRDIFEEMLYMDLRGLRS DDTGIYFCARRHSDYCDFDIWGSGTQIIVSSASTKG |
| 409 | 3BNC196HC | QVQLLQSGAAVTKPGASVRVSCEASGYKISDHFIHWWRQAPGQG LQWVGWINPKTGQPNNPRQFQGRISLTRQASWDFDTFSFYMDLK ALRSDDTAVYFCARQRSDYWDFDVWGSGTQVTVSSASTKG |
| 410 | 3BNC20HC | QVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 411 | 3BNC29HC | WQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 412 | 3BNC31HC | QVQLVQSGAALKKPGASVRISCQTYGYKFTDHLIYWWRQAPGQG LEWIGWIKPETGQPSYSYRFQGRVSLTRDTFEEIVFMDLRGLRSD DTAIYFCARRHSDYCDFDVWGSGSQVLVSSASTKG |
| 413 | 3BNC33HC | WQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 414 | 3BNC42HC | QVQLVQSGAALKKPGASVRISCQAYGYKFTDYLIHWWRQAPGQG LEWIGWIKPETGQPSYSYKFQGRVTLTRDTFEEILFMDLRGLRSDD TAIYFCARRHSDYCDFDVWGSGSQVIVSSASTKGA |
| 415 | 3BNC44HC | EVQLVESGSDVRKPGATVTVSCKADEDEDDFTAYNYFMHWVRQA PGHGLEWIGWINPRTGQPNHAKQFQGRVTLTRERSTSTVFMKLT NLRLDDTAVYFCARPLRGGDTWHYHSWGRGTSLTVSSASTKG |
| 416 | 3BNC45HC | VVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 417 | 3BNC53HC | QVQLVQSGAALKKPGASVRISCQAYGYKFTDHLIYWWRQAPGQG LEWIGWIKPETGQPSYAYKFQGRVTLTRDTFEEIHFMDLRGVRND DTATYFCARRHSDYCDFDVWGSGSQVIVSSASTKG |
| 418 | 3BNC54HC | EVQLVESGSDVRKPGATVTVSCKADEDEDDFTAYNYFMHWVRQA PGHGLEWIGWINPRTGQPNHAKQFQGRVTLTRERSTSTVFMKLT NLRLDDTAVYFCARPLRGGDTWHYHSWGRGTSLTVSSASTKG |
| 419 | 3BNC55HC | QVQLVQSGTAVKRPGASVRVSCQASGYTFTDYFIYWWRQAPGQ GLEWLGWINPLTSQPSYPSRFQGRLTLTRDTFDEMLYMDLRGLR SDDTGIYFCARRHSDYCDFDIWGSGTQIIVSSASTKG |
| 420 | 3BNC59HC | EVQLVQSGSDVRKPGATVTVSCKADEDEDDFTAYNYFMHWVRQ APGHGLEWIGWINPRTGQPNHAKQFQGRVTLTRERSTSTVFMKL TNLRLDDTAVYFCARPLRGGDTWHYHSWGRGTSLTVSSASTKG |
| 421 | 3BNC60HC | QVHLSQSGAAVTKPGASVRVSCEASGYKISDHFIHWWRQAPGQG LQWVGWINPKTGQPNNPRQFQGRVSLTRQASWDFDTYSFYMDL KAVRSDDTAIYFCARQRSDFWDFDVWGSGTQVTVSSASTKG |
| 422 | 3BNC62HC | QVRLLQSGAAVTKPGASVRVSCEASGYEIRDYFIHWWRQAPGQG LQWVGWINPKTGQPNNPRQFQGRVSLTRQASWDFDSYSFYMDL KALRSDDTGVYFCARQRSDYWDFDVWGSGTQVTVSSASTKG |
| 423 | 3BNC64HC | QVHLSQSGAAVTKPGASVRVSCEASGYKISDHFIHWWRQAPGQG LQWVGWINPKTGQPNNPRQFQGRVSLTRQASWDFDTYSFYMDL KALRSDDTAIYFCARQRSDFWDFDVWGSGTQVTVSSASTKG |
| 424 | 3BNC65HC | QVQLLPFGGAVTKPGASVRVSCEASGYNIRDYFIHWWRQAPGQG LQWVGWINPKTGQPNNPCQFQGRVSLTRPASWDFDTISFYMDLK ALRLDDTAVYFCARQRSDYWDFDVWGSGTQVTVSSASTKG |
| 425 | 3BNC66HC | QVQLVQSGAALKKPGASLRISCQTYGYKFTDHLIYWWRQAPGQG LEWIGWIKPETGQPSYSYRFQGRVSLTRDTFEEIAFMDLRGLRSD DTAIYFCARRHTDYCVFDVWGSGSQIIVSSASTKG |

TABLE A-continued

| Seq ID No. | Antibody | Heavy Chain Amino Acid Sequence |
|---|---|---|
| 426 | 3BNC6HC | QVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG |
| 427 | 3BNC72HC | QVQLVQSGAALKKPGASLRISCQTYGYKFTDHLIYWWRQAPGQGLEWMGWIKPETGQPSYSYRFQGRVSLTRDTFEEIVFMDLRGLRSDDTAIYFCARRHSDYCDFDVWGSGSQVIVSSASTKG |
| 428 | 3BNC75HC | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVYSASTKG |
| 429 | 3BNC79HC | QVQLLQSGAAVTKPGASVRVSCEASGYNIRDYFIHWWRQAPGQGLQWVGWINPKTGQPNNPRQFQGRVSLTRQASWDFDTISFYMDLKALRLDDTAVYFCARQRSDYWDFDVWGSGTQVTVSSASTKG |
| 430 | 3BNC81HC | RQVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQILVSSASTKG |
| 431 | 3BNC84HC | QVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQVIVSSASTKG |
| 432 | 3BNC86HC | QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG |
| 433 | 3BNC87HC | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKG |
| 434 | 3BNC89HC | QVQLVQSGTAVKRPGASVRVSCQASGYTFIDHFIYWWRQAPGQGLEWLGWINPLTSQPSYPSRFQGRLTLTRDTFDEMLYMDLRGLRSDDTGIYFCARRHSDYCDFDIWGSGTQIIVSSASTKG |
| 435 | 3BNC91HC | QVQLLQSGAAVTKPGASVRVSCEASGYKIRDYFIHWWRQAPGQGLQWVGWINPQTGQPNIPRPFQGRVTLTRHASWDFDTFSFYMDLKALRSDDTAIYFCARRRSDYCDFDVWGSGTHVTVSSASTKG |
| 436 | 3BNC92HC | EVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG |
| 437 | 3BNC94HC | QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG |
| 438 | 3BNC95HC | QVQLLQSGAAVTKPGASVRVSCEASGYNIRDYFIHWWRQAPGQGLQWVGWINPKTGQPNNPRLFQGRVSLTRHASWDFDTFSFYMDLKAVRSDDTAVYFCARQRSDYWDFDVWGSGTQVTVSSASTKG |

TABLE B

| Seq ID No. | Antibody | Light Chain Amino Acid Sequence |
|---|---|---|
| 439 | 8ANC131KC | EIVLTQSPATLSLSPGERATLSCRASQGLNFVVWYQQKRGQAPRLLIHAPSGRAPGVPDRFSARGSGTEFSLVISSVEPDDFAIYYCQEYSSTPYNFGPGTRVDRKRTVAAPSVFIFPPSDEQ |
| 440 | 8ANC134KC | EIVLTQSPATLSLSPGERATLSCRASQGLNFVVWYQQKGGQAPRLLIHGPTDRAPGVPDRFSARGSGTEFSLVISSVEPDDFALYYCQEYSSTPYNFGPGTRVDRKRTVAAPSVFIFPPSDEQ |
| 441 | 8ANC13KC | EIVLTQSPATLSLSPGERATLSCRASQGLNFVVWYQQKRGQAPRLLIHGPSHRAPGVPDRFSARGSGTEFSLVISSVEPDDFAIYYCQEYSSTPYNFGPGTRVDRKRTVAAPSVFIFPPSDEQ |
| 442 | 8ANC45KC | EIVLTQSPATLSLSPGERATLSCRASQGVNFVVWYQQKRGQAPRLLIYGPSNRAPGVPDRFSARGSGTEFSLVISSVEPDDFALYYCQEYSSTPYNFGPGTRVDRKRTVAAPSVFIFPPSDEQ |

TABLE B-continued

| Seq ID No. | Antibody | Light Chain Amino Acid Sequence |
|---|---|---|
| 443 | 8ANC50KC | EIVLTQSPTTLSLSPGERATLSCRASQGVNLVVWYQQKRGQAPR<br>LLIYGPSDRAPGVPDRFSARGSGTEFSLVISSVEPDDFALYYCQE<br>YSSTPYNFGTGTRVDRKRTVAAPSVFIFPPSDEQ |
| 444 | 8ANC88KC | EIVLTQSPATLSLSPGERATLSCRASQGLNFVVWYQQKRGQAPR<br>LLIHAPSDRAPGVPDRFSARGSGTDFSLVISSVEPDDFAIYYCQEY<br>SSTPYNFGPGTRVDRKRTVAAPSVFIFPPSDEQ |
| 445 | 8anc182kc | EIVLTQSPATLSLSPGERATLSCRASQGVNFVVWYQQKRGQAPR<br>LLIYGPSDRAPGVPDRFSARGSGTEFSLVISSVEPDDFALYYCQE<br>YSSTPYNFGTGTRVDRKRTVAAP |
| 446 | 8anc192kc | EIVLTQSPATLSLSPGERATLSCRASQGVNFVVWYQQKRGQAPR<br>LLIYGNSDRVPGVPDRFSARGSGTEFSLVISSVEPDDFALYYCQE<br>YSSTPYNFGPGTRVDRKRTVAA |
| 447 | 8ANC14KC | SEIVLTQSPATLSLSPGERATLSCRASQSINNYLAWYQQKPGQAP<br>RLLIYDASNRATGIPARFSGGGSGTDFTLTISSLEPEDFAVYYCQQ<br>RANWRLLTFGGGTKVEIKRTVAAPSVFIFPPSDEQ |
| 448 | 8ANC16KC | EIVMTQSPDTLSVSPGERATLSCRASQSVNSNLAWYQQKPGQA<br>PRLLIYGASTRATAVPARFSGSGSGTEFTLTISSLQSEDSAVYYC<br>QQYYQWLSYTFGQGTKLEIKRTVAAPSVFIFPPSDEQ |
| 449 | 8ANC195KC | DIQMTQSPSTLAASIGGTVRVSCRASQSITGNWVAWYQQRPGKA<br>PRLLIYRGAALLGGVPSRFSGSAAGTDFTLTIGNLQAEDFGTFYC<br>QQYDTYPGTFGQGTKVEVKRTVAAPSVFIFPPSDEQ |
| 450 | 8ANC24KC | SEIVMTQSPATLSMSPGERATLSCRASLSVNTNLAWYQQKPGQA<br>PRLLIYGASTRATGIPARFSGSGSGTEFTLTISSLQSEDFALYYCQ<br>QYNHWPQTFGQGTKVEIKRTVAAPSVFIFPPSDEQK |
| 451 | 8ANC5KC | DIQMTQSPPSLSASVGDRVTITCQASQDINNFLNWYQQKPGKAP<br>RLLIYDASNLESGVSSRFSGSRSGTDFTLTISSLLPEDIATYSCQQ<br>YSNLPYTFSQGTKLEIKRTVAAPSVFIFPPSDEQ |
| 452 | 12a12kc | DIQMTQSPSSLSASVGDRVTITCQAGQGIGSSLQWYQQKPGKAP<br>KLLVHGASNLHRGVPSRFSGSGFHTTFSLTISGLQRDDFATYFCA<br>VLEFFGPGTKVEIKRTVAAPSVFIFPPSDEQLKS |
| 453 | 12a13kc | DIQMTQSPSSLSASVGDRVTITCQAGQGIGSSLQWYQQKPGKAP<br>KLLVHGASNLHRGVPSRFSGSGFHTTFSLTISGLQRDDFATYFCA<br>VVEFFGPGTKVDIKRTVAAPSVFIFPPSDEQL |
| 454 | 12a16kc | DIQMTQSPSSLSASVGDRVTITCQASQGIGSSLQWYQQKPGRAP<br>NLLVHGASKLHRGVPSRFSGSGFHTTFSLTISGLQRDDFATYFCA<br>VLEFFGPGTKVEIKRTVAAPSVFIFPPSDEQLK |
| 455 | 12a1kc | DIQMTQSPSSLSASVGDRVSINCQAGQGLGSSLNWYQQKPGRA<br>PKLLVHGASNLQRGVPSRFSGSGFHTTFTLTISSLQPDDVATYFC<br>AAFQWFGPGTKVEIKRT |
| 456 | 12a20kc | DIQMTQSPSSLSASVGDRVSIHCQAGQGIGSSLNWYQQKPGRAP<br>RLLVHGASNLRGVPSRFSGSGFHTTFTLTISSLQPDDVATYWC<br>AALEFFGPGTKVEI |
| 457 | 12a21kc | DIQMTQSPSSLSASVGDRVTINCQAGQGIGSSLNWYQKKPGRAP<br>KLLVHGASNLQRGVPSRFSGSGFHTTFTLTISSLQPDDVATYFCA<br>VFQWFGPGTKVDIKRTVAAPSVFIFPPSDEQLK |
| 458 | 12a22kc | DIQMTQSPSSLSASVGDRVTITCQAGQGIGSSLNWYQQKPGRAP<br>KLLVYGASNLQRGVPSRFSGSGFHTTFTLTISSLQPEDFATYFCS<br>VYEFLGPGTKVEIKRTVAAPSVFIFPPSDEQ |
| 459 | 12a23kc | DIQMTQSPSSLSVSVGDRVSITCRATQGIGNSLNWYQQKPGKAP<br>KVLIYGTTKLHGGVPSRFSGGGSGTGTLTIDSLQPEDIATYFCQL<br>FEFFGPGTKVEIKRTVAAPSVFIFPPSDEQ |
| 460 | 12a27kc | DIQMTQSPSSLSASVGDRVTITCQASQGIGSSLQWYQQKPGRAP<br>NLLVHGASNLHRGVPSRFSGSGFHTTFSLTISGLQRDDFATYFCA<br>VLEFFGPGTKVDIKRTVAAPSVFIFPPSDEQ |
| 461 | 12a46kc | DIQMTQSPSSLPASVGDTVTITCQAGQGIGSSLQWYQQRPGRAP<br>NLLVYDASNLQRGVPSRFTGTGFHTTFTLTIRGLRPEDFGTYFCA<br>SLEFFGPGTKVDIKRTVAAPSVFIFPPSDEQ |

TABLE B-continued

| Seq ID No. | Antibody | Light Chain Amino Acid Sequence |
|---|---|---|
| 462 | 12a55kc | YIQMTQSPSSLSASIGDRVTITCQAGQGIGSSLNWYQQKPGKAPK LLVHGASNLQRGVSSRFSGSGFHTTFTLTISSLRPEDVGTYFCEV YEFIGPGTKVDIKRTVAAPSVFIFPPSDEQ |
| 463 | 12a56kc | DIQMTQSPSSLSASVGDRVSINCQAGQGIGSSLNWYQQKRGKAP KLLVHGASTLQRGVPSRFSGSGFHTTFTLTISSLQPDDVATYFCE SFQWFGPGTKVEIKRTVAAPSVFIFPPSDEQ |
| 464 | 12a6kc | DIQMTQSPSSLSASVGDRVTITCQASQGIGSSLQWYQQKPGRAP KLLVHGASNLHRGVPSRFSGSGFHTSFTLTISSLQPDDVATYFCA VLEFFGPGTKVEIKRTVAAPSVFIFPPSDEQ |
| 465 | 12a7kc | DIQMTQSPSSLSASVGDRVSIHCQAGQGIGSSLKWYQQKSGRAP RLLVHGASNLQRGVPSRFSGSGFHTTFTLTISSLQPDDVATYWC AVLEFFGPGTKVEIKRTVAAPSVFIFPPSDEQ |
| 466 | LSSB2339LC | QSVLTQPPSASGAPGQRVTISCSGGPSNVGGNYVYWYRQFPGT APNLLILRDDQRPSGVPDRFSASKSGNSASLAISGLRPDDEAFYF CATYDSDGSVRLFGGGTTLTVLSQPKAAPSVTLFPPSNGGR |
| 467 | LSSB2351LC | QSALTQPPSVSGAPGQRVTISCSGGPSNVGGNYVYWYQQFPGA APKLLIRRDDQRPSGVPDRFSGSKSGNSASLAISGLRLDDEAYYF CATYDSGWSIRLFGGGTRLTVLSQPKAAPSVTLFPPSSEEL |
| 468 | LSSB2364LC | SQAVVTQPPSVSGAPGQRVTISCSGGPSNVGGNLVYWYKQFPG TAPKLLIRRDDQRPSGVPDRFSGSKSGNSASLAISGLRPDDEAFY FCATYDSHGSIRLFGGGTLLTVLSQPKAAPSVTLFPP |
| 469 | LSSB2367LC | QTVVTQPPSASGTPGQRVTISCSGGGSNIGGNLVSWYQHFPGA APKLLIYRNDQRPSGVPDRFSGSKSGTSASLTISGLRSDDEATYF CAAYDCTLSLRLFGGGTTLNVLSQPKAAPSVTLFPPSSEEL |
| 470 | LSSB2490LC | QSALTQPPSVSGTPGQNVTISCSGGGSNVGGNLVSWYQHFPGA APKLLIHRDNQRPSGVPDRFSVLKSGNSASLAISGPRSDDEAFYF CAVYDSSLSLGLFGGGTKLTVLSQPKAAPSVTLFPPSSEEL |
| 471 | LSSB2530LC | QSALTQPPSASGAPGQRVTISCSGGPSNVGGNYVYWYRQFPGT APTLLILRDDQRPSGVPDRFSASKSGNSASLAISGLRPDDEGYF CATYDSDGSIRLFGGGTALTVLSQPKAAPSVTLFPPSSEELK |
| 472 | LSSB2554LC | NFMLTQAPSASGAPGQRVTISCSGGPSNVGGNYVYWYRQYPGT APKLLILRDDQRPSGVPDRFSASKSGNSASLAISELRPDDEAFYF CATYDSDGSIRLFGGGTALTVLSQPKAAPSV |
| 473 | LSSB2586LC | NFMLTQPPSASGAPGQRVTISCSGGPSNVGGNYVYWYRQFPGT APNLLILRDDQRPSGVPDRFSASKSGNSASLAISGLRPDDEAFYF CATYDSDGSIRLFGGGTTLTVLSQPKAAPSVTLFPP |
| 474 | LSSB2612LC | QSVLTQPPSASGAPGQRVTISCSGGPSNVGGNYVYWYRQFPGT APKLLILRDDQRPSGVPDRFSASKSGNSASLAISGLRPDDEAFYF CATYDSDGSIRLFGGGTALTVLSQPKAAPS |
| 475 | LSSB2640LC | QLVLTQPPSVSGTPGQNVTISCSGGGSHVGGNLVSWYQHFPGA APKLLIHRDNQRPSGVPDRFSALKSGNSASLAISGLRSDDEAFYF CAVYDSSLSLGLFGGGTKLTVLSQPKAAPSVT |
| 476 | LSSB2644LC | RTVVTQPPSVSGAPGQRVTISCTGSSSNIGAGYDVHWYQQLPGT APKLLIYGNSNRPSGVPDRFSGSKSGTSASLAITGLQAEDEADYY CQSYDSSLSGSGVFGTGTKVTVLGQPKANPTVTLFPPSSEEL |
| 477 | LSSB2666LC | QSALTQPPSASGAPGQRVTISCSGGPSNVGGNYVYWYRQFPGT APKLLILRDDQRPSGVPDRFSASKSGNSASLAISGLRPDDEALYF CATYDSDGSIRLFGGGTALTVLSQPKAAPSVTLFPPGWEE |
| 478 | LSSB2680LC | QPVLTQPPSASGAPGQRVTISCSGGPSNVGGNYVYWYRQFPGT APNLLILRDDQRPSGVPDRFSASKSGNSASLAITGLRPDDEAFYF CATYDSDGSIRLFGGGTALTVLSQPKAAPSVTLFPP |
| 479 | LSSB2683LC | QSALTQPPSASGAPGQRVTISCSGGPSNVGGNYVYWYRQFPGT APNLLILRDDQRPSGVPDRFSASKSGNSASLAISGLRPDDEAFYF CATYDSDGSIRLFGGGTTLTVLSQPKAAPSVTLF |
| 480 | LSSB344LC | QSALTQPPSVSGAPGQRVTISCSGGPSNVGGNYVYWYQQFPGA APKLLIRRDDQRPSGVPDRFSGSKSGNSASLAISGLRLDDEAYYF CATYDSGWSIRLFGGGTRLTVLSQPKAAPSVTLFPPSSEEL |

TABLE B-continued

| Seq ID No. | Antibody | Light Chain Amino Acid Sequence |
|---|---|---|
| 481 | LSSNEC107LC | QLVLTQPPSVSATPGQTVTISCSGSGSNVGGNHVYWYRQLPGA APTLVISKTDHRPSRVPDRFSGSKSGNSASLAISGLRPDDEAVYF CATYDTGLSLRLFGGGTRLAVLSQPKAAPSVTLFPPSSEEL |
| 482 | LSSNEC108LC | QSALTQPPATSGTPGQRVTISCSGGGSNVGGNLVSWYQQFPGA APKLILHRDGQRPSGVPDRFSASKSGTSASLTISGLRSDDEATYF CAAFDSALSLPLFGGGTKLTVLSQPKAAPSVTLFPPSSEEL |
| 483 | LSSNEC117LC | QSVLTQVLSVSGTPGQRVIISCSGTSSNVGGNLVSWYQHLPGAA PRLLIHRDDQRPSGVPDRFSGSKSGNSASLVISGLRSDDEADYF CGAYDSTFSLPVFGGGTRLTVLSQPKAAPSVTLFPPSSEEL |
| 484 | LSSNEC118LC | NFMLTQPPSVSATPGQTVTISCSGSGSNVGGNHVYWYRQLPGA APTLVISKTDHRPSRVPDRFSGSKSGNSASLAISGLRPDDEAVYF CATYDTGLSLRLFGGGTRLTVLSQPKAAPSVTQFPPSSEE |
| 485 | LSSNEC122LC | QSALTQPPSVSATPGQTVTISCSGSGSNVGGNHVYWYRQLPGA APTLLISKTNHRPSQVPDRFSASKSGNSASLAISGLRPDDEADYF CGTYDTSLSLRLFGGGTRLTVLSQPKAAPSVTLFPPSSEEL |
| 486 | LSSNEC24LC | QSALTQPPSASGTPGQRVTISCSGGGSNIGGNLVSWYQHFPGTA PKLLIYRNDQRPSGVPDRFSGSKSGTSASLTISGLRSDDEATYFC AAYDSSLSLRLFGGGTTLNVLSQPKAAPSVTLFPPSSEEL |
| 487 | LSSNEC2LC | QSALTQPPSVSGTPGQNVTISCSGGGSDVGGNLVSWYQHFPGA APKLLIHRDNQRPSGVPDRFSALKSGNSASLAISGLRSDDEAFYF CAVYDSSLSLGLFGGGTKLTVLSQPKAAPSVTLFPPSSEEL |
| 488 | LSSNEC33LC | QAVVTQPPSVSATPGQTVTISCSGSGSNVGGNHVYWYRQLPGA APTLLISKTNRRPSQVPDRFSGSKSGNSASLAISGLRPDDEADYF CATYDTDLSLRLFGGGTRLTVLSQPKAAPSVTLFPPSSEEL |
| 489 | LSSNEC46LC | QSALTQPPAASGAPGQRVTISCSGGGSNVGGNLVSWYQQFPGA APKLILHRDGQRPSGVPDRFSASKSGTSASLTISGLRSDDEATYF CAAYDSAVSLPVFGGGTKLTVLSQPKAAPLVT |
| 490 | LSSNEC48LC | NFMLTQPPSASGTPGQRVTISCSGGGSNIGGNLVSWYQHFPGA APKLLIYRNDQRPSGVPDRFSGSKSGTSASLAISGLRSDDKATYF CAAYDSTLSLRLFGGGTTLTVLSQPKAAPSVTLFPPSSEE |
| 491 | LSSNEC52LC | QSVLTQVLSVSGTPGQRVIISCSGTSSNVGGNLVSWYQHLPGAA PRLLIHRDDQRPSGVPDRFSGSKSGNSASLVISGLRSDDEADYF CAAYDSTFSLPVFGGGTRLTVLSQPKAAPSVTLFPPSSE |
| 492 | LSSNEC56LC | QSALTQPPSVSATPGQTVTISCSGSGSNVGGNHVYWYRQLPGA APTLLISKTDHRPSRVPDRFSASKSGNSASLAISGLRPDDEAIYFC ATYDTGLSLRLFGGGTRLTVLSQPKAAPSVTLFPPSSEEL |
| 493 | LSSNEC60LC | QSALTRTPSVSGAPGQRVTISCSGGPSNVGGNYVYWYQQFPGA APKLLIRRDDQRPSGVPDRFSGSKSGNSASLAISGLRLDDEAYYF CATYDSGWSIRLFGGGTRLTVLSQPKAAPSVTLFPPSSEEL |
| 494 | LSSNEC70LC | QSALTQAPSASGTPGQRVTISCSGGGSNIGGNLVSWYQHFPGA APKLLIYRNDQRPSGVPDRFSASKSGTSASLAISGLRSDDEATYF CAAYDSTLSLRLFGGGTTLAVLSQPKA |
| 495 | LSSNEC72LC | NFMLTQPPSVSGAPGQRVTISCSGGPSNVGGNLVYWYKQFPGT APKLLIRRDDQRPSGVPDRFSGSKSGNSASLAISGLRPDDEAFYF CATYDSHGSIRLFGGGTLLTVLSQPKAAPSVTLFPPSSEEL |
| 496 | LSSNEC7LC | QLVLTQPPSVSGAPGQRVTISCSGGPSNVGGNLVYWYKQFPGT APKLLIRRDDQRPSGVPDRFSGSKSGNSASLTISGLRPDDEAFYF CATYDSQGSTRLFGGGTVLTVLSQPKAAPSVTLFPPSSEEL |
| 497 | LSSNEC89LC | QSALTQPPSVSGAPGQRVTISCSGGPSNVGGNYVYWYRQFPGT APKLLILRDDQRPSGVPDRFSASKSGNSASLAISGLRPDDEAFYF CATYDSQGSFRVFGGGTALTVLSQPKAAPSVTLYPPSSEE |
| 498 | LSSNEC94LC | NFMLTQPPSASGAPGQRVTISCSGGPSNVGGNYVYWYRQFPGT APNLLILRDDQRPSGVPDRFSASKSGNSASLAISGLRPDDEAFYF CATYDSDGSIRLFGGGTTLTVLSQPKAAPSVTLFPPSSEEL |
| 499 | LSSNEC9LC | QVLSVSGTPGQRVIISCSGTSSNVGGNLVSWYQHLPGAAPRLLIH RDDQRPSGVPDRFSGSKSGNSASLVISGLRSDDEADYFCAAYDS TFSLPVFGGGTRLTVLSQPKAAPSVTLYAPSSEE |

TABLE B-continued

| Seq ID No. | Antibody | Light Chain Amino Acid Sequence |
|---|---|---|
| 500 | LSSB2066KC | PVTLSASVGDRVTITCRASEDISKYLNWYQHKPGKAPKLLIYTASS LETGVPSRFSGSGSGTDFSLTISSLQPDDFATYYCQQSYTSSVTF GQGTRVEVKRTVAAPSVFIFPPSDEQ |
| 501 | LSSB2080KC | PATLAVSPGERATISCKSSQNLLYSANNQHSLAWYQQRPGQPPK LLLYWASTRLSGVPDRFSGSGSGTDFTLTISNLQAEDVAVYYCQ QYYSPPPTFGQGTKVEIRRTVAAPSVFIFPPSDEQL |
| 502 | LSSB2133KC | TLSASVGDRVTITCRASQSINNYLNWYQQKPGKAPKLLIYAASSL QSGVPSRFSGSGSGTDFTLTISSLQPEDFVTYYCQQTYSNPRMF GQGTKVEIKRTVAAPSVFIFPPSDEQ |
| 503 | LSSB2182KC | KAPATLSLSPGERATLSCRASQSVGSDLAWYQQKPGQAPRLLIY DASNRATAIPARFSGSGSGTDFTLSISSLEPEDFAVYFCQQRYDKI TFGQGTRLEIQRTVAAPSVFIFPPSDEQ |
| 504 | LSSB331KC | RGPVTLAVSLGERATITCKSSQSVLVHSNNKNYLSWYQQKPGQP PKLLIYWASTRESGVPERFSGSGSGTDFTLSISSLQAEDVAVYYC HQYFSTPRTFGQGTKVEIKGTVAAPSVFIFPPSDEQL |
| 505 | 3A124KC | SEIVLTQSPATLSLSPGESATLSCRASQSLSSSLAWYQQKPGQAP RLLIYDTSDRATGIPARFSGRGSGTDFTLTISSLEPEDFAVYYCQQ RSNWAITFGQGTRLEIKRTVAAPSVFIFPPSD |
| 506 | 3A125KC | EIVLTQSPGTLSLSPGEXATLSCRASQTISNNYLXWYQQKAGQAP RLLIYGASSGATGIPDRFSGSGSGTDFTLTISRLEPEDFAVYYCQQ YGLSPWTFGRGTKVEIKRTVAAPSVFIFPPSD |
| 507 | 3A140LC | QSALTQPRSVSGSPGQSVTISCTGTSSDVGAYNYVSWYRQHPG KAPKLMINDVSKRPSGVPDRFSGSKSGNTASLTISGLQAEDEADY YCCSYAGTYSYVFGTGTKVTVLGQPKANPTVTLFPPSSEEL |
| 508 | 3A144KC | APVTLSASVGDTVTITCRASQPIATFLNWYQHKPGQAPKLLIYAAS TFQRGAPSRYSGSGSGTDFTLTINSLQPEDLATYYCQQTFTDPVT FGQGTRLEIKRTVAAPSVFIFPPSD |
| 509 | 3A160KC | DIQMTQSPASLSASVGDRVTITCRASQGISHYLAWYQQKPGKVP RLLIYAASRLQSGVTSRFSGSGSGTEFTLTISSLLPEDAAVYFCQK YDTDPMTFGQGTRLEIKRTVAAPSVFIFPPSD |
| 510 | 3A18KC | DIQMTQSPSSLSASIGDRVTITCRANQHIRSFLNWYQQTPGKAPK LLIYAASTLQRGVPSRFSGSGSGTDFTLTITSLEREDLATYYCQQT YTSPITFGQGTRLEIKRTVAAPSVFIFPPSDE |
| 511 | 3A204KC | EIVLTQSPGTLSLSPGERATLSCRASQSVSNNYLAWYQQKPGQA PRLLIYGASSRATGIPDRFSGSGSGTDFTLTISRLEPEDFAVYYCQ QYATSSLYTFGQGTKLEIKRTVAAPSVFIFPPSD |
| 512 | 3A228KC | LSVSLGERATINCKSSQSILYSSDKKNYLAWYQQKIGQPPKLLLY WASTRESGIPDRFSGSGSGSDFTLTISSLQPEDVAVYYCQQYYIS PFTFGPGTKVDLKRTVAAPSVFIFPPSD |
| 513 | 3A233LC | NFMLTQPASVSGSPGQSITLSCTGTTSDVRDSNFVSWYQQVPG KAPKLIIYDVSARPSGVSFRFSGSKSGNTASLTISGLQAEDEALYY CSSFTPTNTLVFGGGTKLTVLGQPKAAPSVT |
| 514 | 3A244LC | SQSVVTQEPSLTVSPGGTVTLTCGPSTGAVTSGFYPHWFQQKP GQAPRALIYSTSNKYSWTPARFSGSLLGGKAVLTLSDVQPDDEA EYYCLLLLYYGGPWIFGGGTKLTVLVS |
| 515 | 3A255LC | QAVVTQEPSLTVSPGGTVTLTCASSTGAVTSGFYPHWFQQKPG QAPRALIYSTSNRYSWTPARFSGSLLGGKAALTLSGVQPEDEAE YYCLLLPYYGGPWIFGGGTKLTVLGQPKAAPSVTLFPPSSEEL |
| 516 | 3A296KC | EIVMTQSPATLSVSPGDRATLSCRASQSVSTNLAWYQQKPGQAP RLLIYGASTRATGIPATFSGSGFATEFTLTISSLQSEDFAVYYCQQ YNNWPPAFGQGTKVEIKRTVAAPSVFIFPPSD |
| 517 | 3A334LC | QSVLTQPPSASGSPGQSITISCTGTSSDVGGYNYVSWYQQPPGK APKVIIYEVSKRPSGVPDRFSGSKSGNTASLTVSGLQAEDEADYY CSSYAGSNNFVFGTGTEVTVVGQPKANPTVTLFPPSSEELL |
| 518 | 3A366KC | SLSASVGDRVTITCRASESISFYLNWYQQKPGKAPELLIFATSTLH SGVPSRFSGSGSGTDFTLTISSLQLEDFATYYCQQSSSTPFTFGG GTKVEIKRTVAAPSVFIFPPSD |

TABLE B-continued

| Seq ID No. | Antibody | Light Chain Amino Acid Sequence |
|---|---|---|
| 519 | 3A384KC | DIQMTQSPSSLSAYVGDRVTITCRASQNINTYLNWYQQRPGKAPKLLIYAASTLQSGVPSRFSGSGSGTDFTLTISNLETEDFAVYYCQQTYRSVTFGQGTKLEIKRTVAAPSVFIFPPSD |
| 520 | 3A419KC | LSAYVGDRVTITCRASQNINTYLNWYQQRPGKAPKLLIYAASTLQSGVPSRFSGSGSGTDFTLTISNLETEDFAVYYCQQTYSSVTFGQGTKLETRRTVAAPSVFIFPPSD |
| 521 | 3A461KC | SEIVLTQSPGTLSLSPGERATLSCRASQSVSSSYLAWYQQKPVQAPRLLIYGASSRATGIPDRFSGSGSGTDFTLTISRLEPEDFAVYYCQQYGTLHPRTFGQGTKVEIKRTVAAPSVFIFPPSD |
| 522 | 3A474KC | EIVLTQSPGTLSLSPGERATLSCRASQSISSNYLAWYQQKPGQAPRLLIYGASTRATGIPDRFSGSGSGTDFTLSISRLEPEDIAVYYCHQYGSSQRFGQGTKVEIKRTVAAPSVFIFPPSD |
| 523 | 3A518KC | DIQMTQSPSSLSASVGDRVTITCRASQSISRYLNWYQQKPGKAPKLLIYAASSLQGGVPSRFSGSGSGTDFTLTISSLQPEDFATYYCQQSSSKPFTFGGGTKVEIKRTVAAPSVFIFPPSD |
| 524 | 3A539LC | NFMLTQPASVSGSPGQSITISCSGTGSDIGVYNYVSWYQQHPGKAPRLMIYDVTNRPSGVSNRFSGSKSGFTASLTISGLQGDDEADYYCSSYSSTNTYVFGTGTHVTVLGQPKANPTVTLFPPSSEEL |
| 525 | 3A576LC | QSALTQPPSASGTPGQRVTISCSGSYHNIGSNAVNWYQQLPGTAPKLLIYSNDQRPSGVPDRFSGSKSGTSASLAISGLQSEDEADYYCAAWDDSLHVFGTGTKVTVLGQPKANPTVTLFPPSSEEL |
| 526 | 3A613LC | QSALTQPPSASGTPGQRVTISCSGSYHNIGSNAVNWYQQLPGTAPKLLIYSNDQRPSGVPDRFSGSKSGTSASLAISGLQSEDEADYYCAAWDDSLHVFGTGTKVTVLGQPKANPTVTLFPPSSEEL |
| 527 | 3A64KC | DIQMTQSPSSLSASVGDRVTITCRASQDITTYLAWLQQKPGKAPKSLIYSASTVQSGVPSRFSGSGSGTEFTLTISGLQPEDFATYYCQQYNYYPITFGLGTRLEIKRTVAAPSVFIFPPSDE |
| 528 | 3A650KC | IILFLVATATGSWAQSALTQPRSVSGSLGQSVTISCTGSSSDVGRYNYVSWYQHHPGKAPKLMISDVNKRPSGVPDRFSGSKSGNTASLTISGLQAEDETDYYCCSYAGSYIWVFGG |
| 529 | 3A67KC | EIVLTQSPATLSLSPGERATLSCRASQSVSSYLAWYQQKPGQAPRLLIYDASNRATGIPARFSGSGSDTDFTLTISSLEPEDFAVYYCQQRGIWPLQITFGQGTRLEIKRTVAAPSVFIFPPSDE |
| 530 | 3A779KC | LSASVGDRVTITCRASQSIDRYLNWYQQKPGKAPKLLIYAASSLHTDVPSRFSGSGAGTYFTLTITSLQPEDFATYYCQQSHSPSFGQESYSITFGQGTRLEIKRTVAAPSVFIFPPSD |
| 531 | 3A816KC | VTLSLSPGERATLSCRASQTISNNYLAWYQQKPGQAPRLLIYGASSGATGLPDRFSGSGSGTDFTLTISRLEPEDFAVYYCHQYALSPWTFGRGTKVEIKRTVAAPSVFIFPPSD |
| 532 | 3A869KC | IILFLVATATGVHSDIQMTQSPSSLSASVGDRVTITCRASQSIDRYLNWYQHKPGKAPKLLIYAASNLHTDVPSRFSGSGAGTYFTLTITSLQPEDFATYYCQQSHSPSFGQESYSIAFGQGTRLEIKRTVAAPSVFIFPPSDE |
| 533 | 3A93LC | QSVLTQPASVSGSPGQSITISCTGTNSDVGYSYVSWFQQHPGKVPKLLIYDVSRRSSGVSNRFSGSRSGNTASLTISGLRAEDEADYYCGSFTTSLTLVFGGGTKLAVLVSPS |
| 534 | 3a426kc | EIVLTQSPGTLSLSPGERATLSCRASQSVSSRYLAWYQQKPGQAPRLIIYDASSRASGIPDRFSGSGSETDFTLTITRLEPEDFAVYYCLYGTSPKFTFGQGTKLEIKRTVAAPSVFIFPPSD |
| 535 | 3a515kc | DVVMTQSPLSLPVTLGQPASISCRSSQSLVYSHGDTYLKCFQQRPGQSPRRPIYKVSNRDSGVPDRFSGSGSGTDFTLKISRVEAEDVGV |
| 536 | 3b129kc | GPATLSVSPGERATLSCRASQSLRNNLAWYQQKTGQSPRLLIYAVSTRATGIPPRFSGGGSGTEFTLTIDSLQSEDFAVYFCQQYDSPQWTFGQGTKVEIKRTVAAPSVFIFPPSD |
| 537 | 3b1711c | QSVLTQPASVSGSPGQSITISCTGTSNDVGGQNFVSWYQQHPGTAPQLLIYDVTNRPAGVSSRFSGSKSGNTASLTISGLRTEDEADYYCASFTILNGVDYVFGTGTKVTVLLSPSQPYL |

TABLE B-continued

| Seq ID No. | Antibody | Light Chain Amino Acid Sequence |
|---|---|---|
| 538 | 3b27kc | EIVLTQSPATLSVSPGERATLSCRAGQSVSSDLAWYQHKPGQAP RLLIYDASKRATGIPARFSGSGSGTDFTLTISSLEPEDFAVYYCQH RTNWPPSITFGQGTRLEIKRTVAAPSVFIFPPSD |
| 539 | 3b41kc | EIVLTQSPGTLSLSPGERATLSCRASQSVSSNYLAWYQQKPGQA PRLLIYGASSRATGIPDRFSGSGSGTDFTLSISRLEPEDFAVYYCQ QYGTSSCTFGQGTKLEIKRTVAAPSVFIF |
| 540 | 3b5kc | EIVLTQSPGTLSLSPGDRAALSCRASETLSGNSLAWYQQKRGQP PRLLIFAASSRATGIPERFSGGGSGTDFTLTITRLEPEDFAVYFCQ QYVDAPITFGQGTRLEIKRTVAAPSVFIFPPSD |
| 541 | 3b46kc | EIVLTQSPGTLSLSPGERATLSCRASQSVSSNNLAWYQQKPGQA PRLLMSGASSRATGIPDRFSGSGSGTDFTLTISRLEPEDFAVYHC QQYGSSPPTFGQGTKVEIKRTVAAPSVFIFPP |
| 542 | 3b57lc | QSVLTQPRSVSGSPGQSVTISCTGTSSDVGGYNYVSWYQQHPG KAPKTMIFDVTKRPSGVPDRFSGSKSGNTASLTISGLQAEDEADY YCSSYAGRNTFYVFGTGTTVTVQVSPSQPPP |
| 543 | 3b8kc | EIVLTQSPGTLSLSPGERATLSCRASQSVSSNLAWYAQKPGQAP RLIIYGASSRASAIPDRFRGSGSGTDFTLTISRLEPEDFAVYYCQQ YDDAPITFGHGTRLEIKRTVAAPSVFIFPPSDE |
| 544 | 3BNC55KC | DIQMTQSPSSLSASVGDKVTITCQTSAGYLNWYQQRRGRAPKLL MYDGSRLVTGVPSRFSGRRWGTQYNLTIGSLQPEDIATYYCQVY EFFGPGTRLDLKSTVAA |
| 545 | 3BNC60KC | DIQMTQSPSSLSARVGDTVTITCQANGYLNWYQQRRGKAPKLLIY DGSKLERGVPARFSGRRWGQEYNLTINNLQPEDVATYFCQVYEF IVPGTRLDLKRTVAA |
| 546 | 3anc3kc | DIQMTQSPSSVSASVGDRVTITCQASRDTDNSLTWYQQKPGRPP KLLIYHVVNLGPGVPSRFSGSASSATQSTLIISDFQPDDVATYFCQ NYEFFGPGTKVEIKRTVAAPSVFIFPPSDEQ |
| 547 | 3b106kc | DIQMTQSPSSLSASVGDTVTITCQANGYLNWYQQRRGKAPKLLIY DGSKLERGVPSRFSGRRWGQEYNLTINNLQPEDIATYFCQVYEF VVPGTRLDLKRTVAAPSVFIFPPSD |
| 548 | 3b16kc | DIQMTQSPSSLSASVGDTVTITCQANGYLNWYQQRRGKAPKLLIY DGSKLERGVPSRFSGRRWGQEYNLTINNLQPEDIATYFCQVYEF VVPGTRLDLKRTVAAPSVFIFPPSD |
| 549 | 3b180kc | DIQMTQSPSSLSARVGDTVTFTCQANGYLNWYQQRRGKAPKLLI YDGSKLERGVPSRFSGRGWGQEYNLTINNLQPEDIATYFCQVYE FAVPGTRLDLKRTVAAPSVFIFPPSD |
| 550 | 3b183kc | DIQMTQSPSSLSARVGDTVTITCQANGYLNWYQQRRGKAPKLLIY DGSKLETGVPSRFTGRRWGQEYNLTINNLQPEDIATYFCQVYEFI VPGTRLDLKRTVAAPSVFIFPPSD |
| 551 | 3b191kc | DIQMTHSPSSLSASVGDTVTITCQANGYLNWYQQRRGKAPKLLIY DGSKLETGVPSRFTGRRWGQEYNLTINNLQPEDIATYFCQVYEFI VPGTRLDLKRTVAAPSVFIFPPSD |
| 552 | 3b21kc | DIQMTQSPSSLSARVGDTVTITCQANGYLNWYQQRRGKAPKLLIY DGSKLETGVPSRFTGRRWGQEYNLTINNLQPEDIATYFCQVYEFI VPGTRLDLKRTVAAPSVFIFPPSD |
| 553 | 3bnc102kc | DIQMTQSPSSLSASVGDRVTITCQASQGISNSLNWYQQKPGKAP RLLIYGTSTLQRGVPSRFSGSGSGTRFTVTINSLQPEDIATYFCQH NEFFGRGTKVDIKRTVAAPSVFIFPPSDEQL |
| 554 | 3bnc104kc | DIQMTQSPSSLSASIGDRVNITCQASRDTGSALNWYQQKVGRPP RLLISAVSNLGAGVPSRFSGRRSGTQSTLTINTLQPEDIATYFCQH YEFFGPGTKVDIKRTVAAPSVFIFPPSDEQ |
| 555 | 3bnc105kc | DIQMTQSPSSLSASVGDTVTFTCQANGYLNWYQQRRGKAPKLLI YDGSRLERGVPSRFSGRRWGQEYNLTINNLQPEDIATYFCQVYE FAVPGTRLDLKRTVAAPSVFIFPPSD |
| 556 | 3bnc107kc | DIQMTQSPSSLSASVGDTVTITCQTNKGYLNWYQQRRGRAPKLL MYDGSKLVTGVPSRFSGRRWGTQYNLTIGSLQPEDIATYYCQVY EFFGPGTRLDLKRTVAAPSVFIFPPSD |

TABLE B-continued

| Seq ID No. | Antibody | Light Chain Amino Acid Sequence |
|---|---|---|
| 557 | 3bnc108kc | DIQMTQSPSSLSARVGDKVTITYQTSAGYLNWYQQRRGRAPKLL MYDGSRLVTGAPSRFSGRRWGTQYNLTIGSLQPEDIATYYCQVY EFFGPGTRLDLKRTVAAPSVFIFPPSD |
| 558 | 3bnc117kc | DIQMTQSPSSLSASVGDTVTITCQANGYLNWYQQRRGKAPKLLIY DGSKLERGVPSRFSGRRWGQEYNLTINNLQPEDIATYFCQVYEF VVPGTRLDLKRTVAAPSVFIFPPSD |
| 559 | 3bnc134kc | DIQMTQSPSSLSASVGDTVTINCQTNKGYLNWYQQRRGRAPKLL MYDGSKLVTGVPSRFSGRRWGTQYNLTIGSLQPEDIATYYCQVY EFFGPGTRLDLKRTVAAPSVFIFPPSD |
| 560 | 3bnc142kc | DIQMTQSPSSLSASVGDTVTITCHTNKGYLNWYQQRRGRAPKLL MFDGSKLVTGVPSRFSGRRWGTQYNLTIGSLQPEDIATYYCQVY EVFGPGTRLDLKRTVAAPSVFIFPPSD |
| 561 | 3bnc151kc | DIQMTQSPSSLSASVGDTVTITCQTNKGYLNWYQQRRGRAPKLL MYDGSKLVTGVPSRFSGRRWGTQYNLTIGSLQPEDIATYYCQVY EFFGPGTRLDLKRTVAAPSVFIFPPSD |
| 562 | 3bnc153kc | DIQMTQSPSSLSASVGDTVTITCQTNKGYLNWYQQRRGRAPKLL MYDGSKLVTGVPSRLSGRRWGTQYNLTIGSLQPEDIATYYCQVY EFFGPGTRLDLKRTVAAPSVFIFPPSD |
| 563 | 3bnc156kc | DIQMTQSPSSLSASVGDTVTITCQTNKGYLNWYQQKRGRAPKLL MYDGSKLVTGVPSRLSGRRWGTQYNLTIGSLQPEDIATYYCQVY EFFGPGTRLDLKRTVAAPSVFIFPPSD |
| 564 | 3bnc158kc | DIQMTQSPSSLSASVGDTVTITCQTNKGYLNWYQQRRGRAPKLL MYDGSKLVTGVPSRLSGRRWGTQYNLTIGSLQPEDIATYYCQVY EFFGPGTRLDLKRTVAAPSVFIFPPSD |
| 565 | 3bnc159kc | DIQMTQSPSSLSASVGDTVTITCQTNKGYLNWYQQRRGRAPKLL MYDGSKLVTGVPSRFSGRRWGTQYNLTIGSLQPEDIATYYCQVY EFFGPGTRLDLKRTVAAPSVFIFPPSD |
| 566 | 3bnc15kc | DIQMTQSPSSLSASVGDTVTITCQTNKGYLNWYQQRRGRAPKLL MYDGSKLVTGVPSRLSGRRWGTQYNLTIGSLQPEDIATYYCQVY EFFGPGTRLDLKRTVAAPSVFIFPPSD |
| 567 | 3bnc176kc | DIQMTQSPSSLSASVGDTVTITCQANGYLNWYQQRRGKAPKLLIY DGSKLERGVPSRFSGRRWGQEYNLTINNLQAEDIATYFCQVYEF AVPGTRLDLKRTVAAPSVFIFPPSD |
| 568 | 3bnc193kc | DIQMTQSPSSLSARVGDKVTITCQTSAGYLNWYQQRRGRAPKLL MYDGSRLVTGVPSRFSGRRWGTQYNLTIGSLQPEDIATYYCQVY EFFGPGTRLDLKRTVAAPSVFIFPPSD |
| 569 | 3bnc196kc | DIQMTQSPSSLSASVGDTVTITCQANGYLNWYQQRRGKAPKLLM YDGSTLERGVPARFSGRRWGQEYNLTINNLQPEDVATYFCQVYE FIVPGTRLDLKRTVAAPSVFIFPPSD |
| 570 | 3bnc31kc | DIQMTQSPSSLSASVGDTVTITCQTNKGYLNWYQQRRGRAPKLL MCDGSKLVTGVPSRFSGRRWGTQYNLTIGSLQPEDIATYYCQVY EFFGPGTRLDLKRTVAAPSVFIFPPSD |
| 571 | 3bnc42kc | DIQMTQSPSSLSASVGDTVTITCQTTKGYLNWYQQRRGRAPKLL MFDGSKLVTGVPSRFSGRRWGTQYNLTIGSLQPEDLATYYCQVY EFFGPGTRLDLKRTVAAPSVFIFPPSD |
| 572 | 3bnc53kc | DIQMTQSPSSLSASVGDTVTITCHTNKGYLNWYQQRRGRAPKLL MFDGSKLVTGVPSRFSGRRWGTQYNLTIGSLQPEDIATYYCQVY EVFGPGTRLDLKRTVAAPSVFIFPPSD |
| 573 | 3bnc62kc | DIQMTQSPSSLSARVGDTVTITCQANGYLNWYQQRRGKAPKLLIY DGSKLETGVPSRFTGRRWGQEYNLTINNLQPEDIATYFCQVYEFI VPGTRLDLKRTVAAPSVFIFPPSD |
| 574 | 3bnc65kc | DIQMTQSPSSLSARVGDTVTFTCQANGYLNWYQQRRGKAPKLLI YDGSKLERGVPSRFSGRRWGQEYNLTINNLQPEDIATYFCQVYE FAVPGTRLDLKRTVAAPSVFIFPPSD |
| 575 | 3bnc66kc | DIQMTQSPSSLSASVGDTVTITCQTNKGYLNWYQQRRGRAPKLL MYDGSKLVTGVPSRLSGRRWGTQYNLTIGSLQPEDIATYYCQVY EFFGPGTRLDLKRTVAAPSVFIFPPSD |

TABLE B-continued

| Seq ID No. | Antibody | Light Chain Amino Acid Sequence |
|---|---|---|
| 576 | 3bnc75kc | DIQMTQSPSSLSARVGDTVTITCQANGYLNWYQQRRGKAPKLLIY DGSKLERGVPSRFSGRRWGQEYNLTINNLQPEDIATYFCQVYEF VVPGTRLDLKRTVAAPSVFIFPPSD |
| 577 | 3bnc79kc | DIQMTQSPSSLSARVGDTVTFTCQANGYLNWYQQRRGKAPKLLI YDGSKLERGVPSRFSGRRWGQEYNLTINNLQPEDIATYFCQVYE FAVPGTRLDLKRTVAAPSVFIFPPSD |
| 578 | 3bnc81kc | DIQMTQSPSSLSASVGDTVTINCQTNKGYLNWYQQRRGRAPKLL MYDGSKLVTGVPSRFSGRRWGTQYNLTIGSLQPEDIATYYCQVY EFFGPGTRLDLKRTVAAPSD |
| 579 | 3bnc84kc | DIQMTQSPSSLSASVGDTVTINCQTNKGYLNWYQQRRGRAPKLL MYDGSKLVTGVPSRFSGRRWGTQYNLTIGSLQPEDIATYYCQVY EFFGPGTRLDLKRTVAAPSVFIFPPSD |
| 580 | 3bnc87kc | DIQMTQSPSSLSARVGDTVTITCQANGYLNWYQQRRGKAPKLLIY DGSKLERGVPSRFSGRRWGQEYNLTINNLQPEDIATYFCQVYEF VVPGTRLDLKRTVAAPSVFIFPPSD |
| 581 | 3bnc89kc | DIQMTQSPSSLSASVGDKVTITCQTSAGYLNWYQQRRGRAPKLL MYDGSRLVTGVPSRFSGRRWGTQYNLTIGSLQPEDVATYYCQV YEFFGPGTRLDLKRTVAAPSVFIFPPSD |
| 582 | 3bnc91kc | DIQMTQSPSSLSARVGDTVTITCQANGYLNWYQQRRGKAPKLLIY DGSKLERGVPSRFSGRRWGQEYNLTINNLQPEDIATYFCQVYEF AVPGTRLDLKRTVAAPSVFIFPPSD |
| 583 | 3bnc95kc | DIQMTQSPSSLSASVGDTVTITCQANGYLNWYQQRRGKAPKLLIY DGSKLERGVPSRFSGRRWGQEYNLTINNLQPEDIATYFCQVYEFI VPGTRLDLKRTVAAPSVFIFPPSD |

TABLE 1

Forward Leader Sequence Primers

| | | |
|---|---|---|
| VH1 LEADER-A | ATGGACTGGACCTGGAGGAT | SEQ ID NO 591 |
| VH1 LEADER-B | ATGGACTGGACCTGGAGCAT | SEQ ID NO 592 |
| VH1 LEADER-C | ATGGACTGGACCTGGACAAT | SEQ ID NO 593 |
| VH1 LEADER-D | GGCCTTCTCTTTGTGGTGGC | SEQ ID NO 594 |
| VH1 LEADER-E | ATGGACTGGACCTGGAGGGT | SEQ ID NO 595 |
| VH1 LEADER-F | ATGGACTGGATTTGGAGGAT | SEQ ID NO 596 |
| VH1 LEADER-G | AGGTTCCTCTTTGTGGTGGCAG | SEQ ID NO 597 |
| VH3 LEADER-A | TAAAAGGTGTCCAGTGT | SEQ ID NO 598 |
| VH3 LEADER-B | TAAGAGGTGTCCAGTGT | SEQ ID NO 599 |
| VH3 LEADER-C | TAGAAGGTGTCCAGTGT | SEQ ID NO 600 |
| VH3 LEADER-D | GCTATTTTAAAGGTGTCCAGTGT | SEQ ID NO 601 |
| VH3 LEADER-E | TACAAGGTGTCCAGTGT | SEQ ID NO 602 |
| VH3 LEADER-F | TTAAAGCTGTCCAGTGT | SEQ ID NO 603 |
| VH4 LEADER-A | ATGAAACACCTGTGGTTCTTCC | SEQ ID NO 604 |
| VH4 LEADER-B | ATGAAACACCTGTTTCTT | SEQ ID NO 605 |
| VH4 LEADER-C | ATGAAGCACCTGTGGTTCTT | SEQ ID NO 606 |
| VH4 LEADER-D | ATGAAACATCTGTGGTTCTT | SEQ ID NO 607 |
| VH5 LEADER-A | TTCTCCAAGGAGTCTGT | SEQ ID NO 608 |
| VH5 LEADER-B | CCTCCACAGTGAGAGTCT | SEQ ID NO 609 |
| VH6 LEADER-A | ATGTCTGTCTCCTTCCTCATC | SEQ ID NO 610 |
| VH7 LEADER-A | GGCAGCAGCAACAGGTGCCCA | SEQ ID NO 611 |

Reverse Constant Region Primers

| | | |
|---|---|---|
| 3' Cg CH1 (gamma) | GGAAGGTGTGCACGCCGCTGGTC | SEQ ID NO 612 |
| 3' IgG (internal) | GTTCGGGGAAGTAGTCCTTGAC | SEQ ID NO 613 |

TABLE 2

| | gender | clade | year of birth | year of diagnosis | CD4+ T cells/ul | Virus copies/ml | clinical status |
|---|---|---|---|---|---|---|---|
| pt1 | male | B | 1948 | 1985 | 354 | 4722 | non progressor |
| pt3 | male | B | 1965 | 2002 | 427 | 880 | non progressor |
| pt8 | male | B | 1962 | 1989 | 580 | <50 | elite controller |
| pt12 | male | ND | ND | ND | ND | ND | ND |

TABLE 3

A

| Ab Name | VH | D | JH | (-) | CDR3 (aa) | SEQ ID NO |
|---|---|---|---|---|---|---|
| 3BNC4 | 1-2 | 7-27 | 2/6 | 3 | R H S D Y C D F D V | 614 |
| 3BNC23 | 1-2 | 6-25/3-3 | 2/6 | 3 | Q R S D F W D F D V | 615 |

TABLE 3-continued

| | | | | | | |
|---|---|---|---|---|---|---|
| 3BNC42 | 1-2 | 7-27 | 2/6 | 3 | R H S D Y C D F D V | 616 |
| 3BNC53 | 1-2 | 3-3 | 2/6 | 3 | R H S D Y C D F D V | 617 |
| 3BNC55 | 1-2 | 3-3/6-19/5-12 | 2/6 | 3 | R H S D Y C D F D I | 618 |
| 3BNC62 | 1-2 | 6-25/6-13/6-6 | 2/6 | 3 | Q R S D Y W D F D V | 619 |
| 3BNC65 | 1-2 | 6-25/6-6 | 2/6 | 3 | Q R S D Y W D F D V | 620 |
| 3BNC66 | 1-2 | 7-27 | 2/6 | 3 | R H T D Y C D F D V | 621 |
| 3BNC72 | 1-2 | 7-27 | 2/6 | 3 | R H S D Y C D F D V | 622 |
| 3BNC79 | 1-2 | 6-25/6-6 | 2/6 | 3 | Q R S D Y W D F D V | 623 |
| 3BNC81 | 1-2 | 7-27 | 2/6 | 3 | R H S D Y C D F D V | 624 |
| 3BNC89 | 1-2 | 3-3/6-19/5-12 | 2/6 | 3 | R H S D Y C D F D I | 625 |
| 3BNC91 | 1-2 | 2-21/6-25 | 2/6 | 3 | R R S D Y C D F D V | 626 |
| 3BNC95 | 1-2 | 6-25/2-8 | 2/6 | 3 | Q R S D Y W D F D V | 627 |
| 3BNC105 | 1-2 | 6-6/6-25 | 2/6 | 3 | Q R S D Y W D F D V | 628 |
| 3BNC107 | 1-2 | 7-27/3-3 | 2/6 | 3 | R H S D Y C D F D V | 629 |
| 3BNC108 | 1-2 | 3-3/6-19/6-25 | 2/6 | 3 | R H S D Y C D F D I | 630 |
| 3BNC117 | 1-2 | 6-25/2-8 | 2/6 | 3 | Q R S D Y W D F D V | 631 |
| 3BNC134 | 1-2 | 7-27 | 2/6 | 3 | R H S D Y C D F D V | 632 |
| 3BNC142 | 1-2 | 3-3 | 2/6 | 3 | R H S D Y C D F D V | 633 |
| 3BNC151 | 1-2 | 7-27/4-17/3-3 | 2/6 | 3 | R H S D Y C D L D V | 634 |
| 3BNC156 | 1-2 | 3-3/7-27 | 2/6 | 3 | R H S D Y C D F D V | 635 |
| 3BNC159 | 1-2 | 7-27 | 2/6 | 3 | R H S D Y C D F D V | 636 |
| 3BNC176 | 1-2 | 6-25/6-6 | 2/6 | 3 | Q R S D Y W D F D V | 637 |
| 3BNC196 | 1-2 | 6-25/6-6/6-13 | 2/6 | 3 | Q R S D Y W D F D V | 638 |
| 3BNC6 | 1-2 | 3-16/1-7 | 2 | 1 | P L R G G D T W H Y S | 639 |
| 3BNC101 | 1-2 | 1-7/3-16 | 2 | 1 | P L R G G D T W H Y S | 640 |
| 3BNC102 | 1-2 | 3-22/1-26/1-20 | 2 | 3 | P H S P D D A W S L D V | 641 |
| 3BNC126 | 1-2 | 3-22/1-26/1-20 | 2 | 3 | P H S P D D A W S L D V | 642 |
| 3BNC149 | 1-2 | 3-22/1-26/1-20 | 2 | 3 | P H S P D D A W S L D V | 643 |
| 3ANC3 | 1-2 | 2-21/2-15 | 1/2 | 1 | P R G G R D N W S F H V | 644 |
| 3ANC42 | 1-2 | ND | 2 | 2 | P K S G R D Y W S F D L | 645 |
| 3BNC3 | 1-69 | 5-5/5-18/5-24 | 3 | 2 | A T G Y S Y G Y L D A F D I | 646 |
| 3BNC8 | 1-24 | 5-24/4-17 | 4 | 3 | E P R E M G T L T A G F E Y | 647 |
| 3BNC48 | 1-69 | 3-3 | 4 | 5 | G Q T D L N D D L W S D Y S T P G F D Y | 648 |
| 3ANC38 | 1-69 | 3-3 | 4 | 5 | G Q T D L N D D F W S E Y S T P G F D Y | 649 |
| 3BNC49 | 1-69 | 3-22/6-19/5-12 | 6 | 3 | G E F D S S G F D Y E S W Y P Y Y M D V | 650 |
| 3BNC58 | 1-24 | 3-16/3-10 | 4/5 | 2 | A P R L E L G E L S S G F H Y | 651 |
| 3BNC78 | 1-24 | | 4/5 | 2 | A P R L D L G E L S S G F H F | 652 |
| 3BNC78 | 1-24 | | 4/5 | 2 | A P R L D L G E L S S G F H F | 653 |
| 3BNC71 | 1-24 | 1-24 | 4/5 | 3 | D N P L L Q S G E F S S S L D N | 654 |

TABLE 3-continued

| 3BNC71 | 1-24 | 1-24 | 4/5 | 3 | D N P L L Q S G E F S S S L E N | 655 |
| 3BNC144 | 1-69 | 3-9/5-5 | 4 | 3 | A Q G D I L T E G Y F D Y | 656 |

| Ab Name | (+) | Length | Mutations HC | Primer Set | k/l | Vk/l | Jk/l | (−) |
|---|---|---|---|---|---|---|---|---|
| 3BNC4 | 1 | 10 | 72 | new | k | 1D-33 | 3 | 1 |
| 3BNC23 | 1 | 10 | 79 | new | k | 1D-33 | 3 | 1 |
| 3BNC42 | 2 | 10 | 69 | new | k | 1D-33 | 3 | 1 |
| 3BNC53 | 2 | 10 | 74 | new | k | 1D-33 | 3 | 1 |
| 3BNC55 | 2 | 10 | 64 | new | k | 1D-33 | 1/3 | 1 |
| 3BNC62 | 1 | 10 | 81 | new | k | 1D-33 | 3 | 1 |
| 3BNC65 | 1 | 10 | 82 | new | k | 1D-33 | 3 | 1 |
| 3BNC66 | 2 | 10 | 69 | new | k | 1D-33 | 3 | 1 |
| 3BNC72 | 1 | 10 | 72 | new | k | 1D-33 | 3 | 1 |
| 3BNC79 | 1 | 10 | 76 | new | k | 1D-33 | 3 | 1 |
| 3BNC81 | 2 | 10 | 71 | new | k | 1D-33 | 3 | 1 |
| 3BNC89 | 2 | 10 | 68 | new | k | 1D-33 | 3 | 1 |
| 3BNC91 | 2 | 10 | 76 | new | k | 1D-33 | 3 | 1 |
| 3BNC95 | 1 | 10 | 72 | new | k | 1D-33 | 3 | 1 |
| 3BNC105 | 1 | 10 | 77 | new | k | 1D-33 | 3 | 1 |
| 3BNC107 | 2 | 10 | 69 | new | | | | |
| 3BNC108 | 2 | 10 | 62 | new | k | 1D-33 | 3 | 1 |
| 3BNC117 | 1 | 10 | 72 | new | k | 1D-33 | 3 | 1 |
| 3BNC134 | 2 | 10 | 71 | new | k | 1D-33 | 3 | 1 |
| 3BNC142 | 2 | 10 | 72 | new | k | 1D-33 | 3 | 1 |
| 3BNC151 | 2 | 10 | 69 | new | k | 1D-33 | 3 | 1 |
| 3BNC156 | 2 | 10 | 72 | new | k | 1D-33 | 3 | 1 |
| 3BNC159 | 2 | 10 | 71 | new | k | 1D-33 | 3 | 1 |
| 3BNC176 | 1 | 10 | 72 | new | k | 1D-33 | 3 | 1 |
| 3BNC196 | 1 | 10 | 78 | new | k | 1D-33 | 3 | 1 |
| 3BNC6 | 3 | 12 | 55 | new | k | 1D-33 | 1/3 | 1 |
| 3BNC101 | 3 | 12 | 54 | new | | | | |
| 3BNC102 | 1 | 12 | 63 | new | k | 1D-33 | 1/3 | 1 |
| 3BNC126 | 1 | 12 | 65 | new | | | | |
| 3BNC149 | 1 | 2 | 68 | new | | | | |
| 3ANC3 | 3 | 12 | 59 | new | k | 1D-33 | 3 | 1 |
| 3ANC42 | 2 | 12 | 53 | new | k | 1D-33 | 3 | 1 |
| 3BNC3 | 0 | 14 | 22 | new | L | 1-44 | 1 | 2 |
| 3BNC8 | 1 | 14 | 21 | old | k | 3-11 | 2 | 0 |
| 3BNC48 | 0 | 20 | 18 | new | | | | |
| 3ANC38 | 0 | 20 | 12 | new | l | 1-47 | 1/6 | 2 |

TABLE 3-continued

| | | | | | | | |
|---|---|---|---|---|---|---|---|
| 3BNC49 | 0 | 20 | 23 | old | k | 3-20 | 3 | |
| 3BNC58 | 1 | 15 | 16 | old | k | 3-11 | 2 | 0 |
| 3BNC78 | 2 | 15 | 38 | old | | | | |
| 3BNC78 | 2 | 15 | 39 | old | | | | |
| 3BNC71 | 0 | 16 | 22 | old | k | 3-11 | 5 | |
| 3BNC71 | 0 | 16 | 17 | old | k | 3-11 | 5 | |
| 3BNC144 | 0 | 13 | 15 | old | k/l | 1-44/1-47 | 1 | 2 |

| Ab Name | CDR3 (aa) | SEQ ID NO | (+) | Length | Mutations LC | Binding | NEUT | # of Relatives |
|---|---|---|---|---|---|---|---|---|
| 3BNC4 | Q V Y E F | 657 | 0 | 5 | 38 | | + | 7 |
| 3BNC23 | Q V Y E F | 658 | 0 | 4 | 50 | CD4BS | + | 5 |
| 3BNC42 | Q V Y E F | 659 | 0 | 5 | 42 | | − | 1 |
| 3BNC53 | Q V Y E V | 660 | 0 | 5 | 42 | | + | 1 |
| 3BNC55 | Q V Y E F | 661 | 0 | 5 | 32 | | + | 1 |
| 3BNC62 | Q V Y E F | 662 | 0 | 5 | 43 | | + | 4 |
| 3BNC65 | Q V Y E F | 663 | 0 | 5 | 44 | | ND | 1 |
| 3BNC66 | Q V Y E F | 664 | 0 | 5 | 38 | | + | 1 |
| 3BNC72 | Q V Y E F | 665 | 0 | 5 | 38 | | + | 1 |
| 3BNC79 | Q V Y E F | 666 | 0 | 5 | 44 | | ND | 2 |
| 3BNC81 | Q V Y E F | 667 | 0 | 5 | 38 | | ND | 2 |
| 3BNC89 | Q V Y E F | 668 | 0 | 5 | 35 | | + | 1 |
| 3BNC91 | Q V Y E F | 669 | 0 | 5 | 42 | | + | 1 |
| 3BNC95 | Q V Y E F | 670 | 0 | 5 | 39 | | + | 9 |
| 3BNC105 | Q V Y E F | 671 | 0 | 5 | 43 | | ND | 1 |
| 3BNC107 | ND | | | | | | ND | 1 |
| 3BNC108 | Q V Y E F | 672 | 0 | 5 | 38 | | + | 2 |
| 3BNC117 | Q V Y E F | 673 | 0 | 5 | 39 | CD4BS | + | 9 |
| 3BNC134 | Q V Y E F | 674 | 0 | 5 | 38 | | ND | 1 |
| 3BNC142 | Q V Y E V | 675 | 0 | 5 | 42 | | + | 1 |
| 3BNC151 | Q V Y E F | 676 | 0 | 5 | 40 | | ND | 1 |
| 3BNC156 | Q V Y E F | 677 | 0 | 5 | 37 | | + | 1 |
| 3BNC159 | Q V Y E F | 678 | 0 | 5 | 39 | | ND | 1 |
| 3BNC176 | Q V Y E F | 679 | 0 | 5 | 41 | | + | 3 |
| 3BNC196 | Q V Y E F | 680 | 0 | 5 | 43 | | ND | 1 |
| 3BNC6 | Q H Y E F | 681 | 1 | 5 | 44 | | + | 24 |
| 3BNC101 | ND | | | | | | ND | 1 |
| 3BNC102 | Q H Y E F | 682 | 1 | 5 | 34 | | − | 1 |
| 3BNC126 | ND | | | | | | ND | 1 |
| 3BNC149 | ND | | | | | | ND | 1 |
| 3ANC3 | Q H Y E F | 683 | 0 | 5 | 47 | | + | 1 |

TABLE 3-continued

| | | | | | | | | |
|---|---|---|---|---|---|---|---|---|
| 3ANC42 | Q Q Y E F | 684 | 1 | 5 | 41 | | ND | 4 |
| 3BNC3 | A A W D D T L Y V | 685 | 0 | 9 | 19 | CD4i | + | 7 |
| 3BNC8 | Q H R S I W P L M C T | 686 | 2 | 11 | 10 | CD4i | + | 3 |
| 3BNC48 | ND | | | | | | ND | |
| 3ANC38 | G A W D D T L Y V | 687 | 0 | 9 | 8 | CD4i | − | 2 |
| 3BNC49 | ND | | | | | CD4i | ND | 2 |
| 3BNC58 | Q Q R T I W P P G C S | 880 | 1 | 11 | 10 | CD4i | ND | 2 |
| 3BNC78 | ND | | | | | | ND | 1 |
| 3BNC78 | ND | | | | | | ND | 2 |
| 3BNC71 | ND | | | | | CD4i | ND | 1 |
| 3BNC71 | | | | | | CD4i | ND | 1 |
| 3BNC144 | ND | | 1 | 9 | | CD4i | ND | 1 | b

| Ab Name | VH | D | JH | (−) | CDR3 (aa) | SEQ ID NO |
|---|---|---|---|---|---|---|
| 1NC2 | 1-46 | 3-22/5-5 | 4/5 | 4 | N E A D Y H D G N G H S L R G M F D Y | 881 |
| 1NC3 | 1-46 | 6-19 | 4/5 | 3 | A E A E S Q S H S R P I M F D F | 688 |
| 1NC7 | 1-46 | 6-19/1-14 | 4/5 | 3 | A E A E S Q S H S R P I M F D S | 689 |
| 1NC9 | 1-46 | 5-12/2-8 | 4/5 | 4 | Q D S D F H D G H G H T L R G M F D S | 690 |
| 1NC18 | 1-46 | 1-14/2-21 | 4/5 | 2 | N E P Q Y H S L P G M F D Y | 691 |
| 1NC24 | 1-46 | 3-16 | 4/5 | 3 | N E P Q Y H D G N G H S L P G M F D Y | 692 |
| 1NC29 | 1-46 | 3-16/6-19 | 4/5 | 3 | N E P Q Y Y D G S G H S L P G M F D Y | 693 |
| 1NC33 | 1-46 | 5-12 | 4/5 | 5 | L E A D G D D Y S P K M V D Y | 694 |
| 1NC46 | 1-46 | 3-9/3-16 | 4/5 | 3 | R E A D Y H D G N G H T L P G M F D F | 695 |
| 1NC48 | 1-46 | 3-9/6-19 | 4/5 | 2 | N E P Q Y F D G S G H S L P G M F D Y | 696 |
| 1NC52 | 1-46 | 3-16/6-19 | 4/5 | 3 | N E P Q Y Y D G S G H S L P G M F D Y | 697 |
| 1NC56 | 1-46 | 5-12/3-9 | 4/5 | 5 | L E A D G D D Y S P K M F D H | 698 |
| 1NC60 | 1-46 | 3-22/1-26 | 1/5 | 4 | L E A E S D S H S R P I M F D H | 699 |
| 1NC66 | 1-46 | 3-16 | 4/5 | 2 | N E P Q Y H D G N G H S L P G M F D F | 700 |
| 1NC70 | 1-46 | 3-16/6-19 | 4/5 | 3 | N E P Q Y Y D G S G H S L P G M F D Y | 701 |
| 1NC72 | 1-46 | 6-19/1-14 | 4/5 | 3 | A E A E S Q S H S R P I M F D F | 702 |
| 1NC94 | 1-46 | 6-13/6-19 | 4/5 | 3 | A E A A S D S H S R P I M F D H | 703 |
| 1NC95 | 1-46 | 3-16/6-19 | 4/5 | 4 | L E A D G S D Y S P K M F D F | 704 |
| 1NC107 | 1-46 | 3-3/5-12 | 4/5 | 5 | L E A D G D D Y S P K M F D Y | 705 |
| 1NC108 | 1-46 | 3-9/3-16 | 4/5 | 4 | R E A D Y H D G N G H T L P G M F D F | 706 |
| 1NC109 | 1-46 | 5-1/6-19 | 4/5 | 5 | L E A D G D D Y S P K M F D Y | 707 |
| 1NC110 | 1-46 | 5-24/6-19 | 4/5 | 4 | L E A D G D N Y S P K M V D Y | 708 |
| 1NC116 | 1-46 | 2-21 | 4 | 2 | N E P Q Y H S L P G M F D Y | 709 |
| 1NC118 | 1-46 | 3-9/5-12 | 4 | 3 | L E A D G G D Y S P K M F D Y | 710 |

TABLE 3-continued

| | | | | | | |
|---|---|---|---|---|---|---|
| 1NC122 | 1-46 | 3-16/3-3 | 4 | 4 | L E A D G A D Y S P K M F D F | 711 |
| 1NC123 | 1-46 | 6-19 | 4 | 3 | A E A E S Q S H S R P I M F D Y | 712 |
| 1NC127 | 1-46 | 6-13/6-19 | 4/5 | 3 | A E A A S D S H S R P I M F D H | 713 |
| 1B344 | 1-46 | 3-22/1-26 | 1/5 | 4 | L E A E S D S H S R P I M F D H | 714 |
| 1B2416 | 1-46 | 1-14/3-16 | 4 | 4 | N E P Q Y H D D N G H S L P G M I D Y | 715 |
| 1B2503 | 1-46 | 6-19 | 5 | 3 | A E A E S Q S H S R P I M F D S | 716 |
| 1B2573 | 1-46 | 3-22 | 4/5 | 2 | N E P Q Y H D G N G H S L P G M F D S | 717 |
| 1NC5 | 1-69 | 3-3 | 3 | 1 | G R Q T F R A I W S G P P V V F D I | 718 |
| 1NC126 | 1-69 | 3-3 | 3 | 1 | G R Q T F R A I W S G P P A V F D I | 719 |
| 1NC16 | 4-34 | 3-10 | 5 | 2 | A V A G L W F E D A Y N W F G P | 720 |
| 1NC21 | 4-34 | 3-10 | 5 | 2 | A V K G L W F D E T Y T W F G P | 721 |
| 1NC54 | 4-34 | 3-10 | 5 | 2 | A V K G F W F D E P S T W F G P | 722 |
| 1NC57 | 4-34 | 3-10 | 5 | 2 | A V K G F W F D D P Y T W F G P | 723 |
| 1NC115 | 4-34 | 3-10 | 5 | 2 | A V K G F W F D E V Y N W F G P | 724 |

| Ab Name | (+) | Length | Mutations HC | Primer Set | k/l | Vk/l | Jk/l | (-) |
|---|---|---|---|---|---|---|---|---|
| 1NC2 | 2 | 19 | 74 | new | l | 1-47 | 3 | 1 |
| 1NC3 | 2 | 16 | 86 | NEW | l | 1-47 | 6/7 | 1 |
| 1NC7 | 2 | 16 | 77 | new | l | 1-47 | 6/7 | 1 |
| 1NC9 | 4 | 19 | 67 | new | l | 1-47 | 3 | 1 |
| 1NC18 | 1 | 14 | 85 | new | | | | |
| 1NC24 | 2 | 19 | 79 | new | l | 1-47 | 3 | 1 |
| 1NC29 | 1 | 19 | 87 | new | | | | |
| 1NC33 | 0 | 15 | 84 | new | l | 1-47 | 3 | 2 |
| 1NC46 | 3 | 19 | 85 | new | l | 1-47 | 3 | 1 |
| 1NC48 | 1 | 19 | 88 | new | l | 1-47 | 3 | 1 |
| 1NC52 | 1 | 19 | 82 | new | l | 1-47 | 3 | 1 |
| 1NC56 | 2 | 15 | 91 | new | l | 1-47 | 3 | 1 |
| 1NC60 | 3 | 16 | 72 | new | l | 1-47 | 3 | 1 |
| 1NC66 | 2 | 19 | 91 | new | l | 1-47 | 3 | 1 |
| 1NC70 | 1 | 19 | 85 | new | l | 1-47 | 3 | 1 |
| 1NC72 | 2 | 16 | 77 | new | l | 1-47 | 6/7 | 1 |
| 1NC94 | 3 | 16 | 81 | new | l | 1-47 | 3 | 2 |
| 1NC95 | 0 | 15 | 93 | new | | | | |
| 1NC107 | 1 | 15 | 90 | new | l | 1-47 | 3 | 1 |
| 1NC108 | 3 | 19 | 85 | new | l | 1-47 | 3 | 1 |
| 1NC109 | 1 | 15 | 85 | new | | | | |
| 1NC110 | 1 | 15 | 88 | new | | | | |
| 1NC116 | 1 | 14 | 83 | new | | | | |
| 1NC118 | 0 | 15 | 86 | new | l | 1-47 | 3 | 1 |

TABLE 3-continued

| 1NC122 | 1 | 15 | 94 | new | l | 1-47 | 3 | 1 |
|---|---|---|---|---|---|---|---|---|
| 1NC123 | 2 | 16 | 78 | new | l | 1-47 | 3 | 1 |
| 1NC127 | 3 | 16 | 81 | new | l | 1-47 | 3 | 2 |
| 1B344 | 3 | 16 | 72 | new | l | 1-47 | 3 | 1 |
| 1B2416 | 2 | 19 | 81 | new | | | | |
| 1B2503 | 1 | 16 | 78 | new | l | 1-47 | 3 | 1 |
| 1B2573 | 2 | 19 | 81 | new | | | | |
| 1NC5 | 2 | 18 | 47 | new | k | 3-11 | 2 | 0 |
| 1NC126 | 2 | 18 | 47 | new | | | | |
| 1NC16 | 0 | 16 | 75 | new | k | 1D-39 | 2/3 | 0 |
| 1NC21 | 1 | 16 | 58 | new | | | | |
| 1NC54 | 1 | 16 | 59 | new | | | | |
| 1NC57 | 1 | 16 | 61 | new | | | | |
| 1NC115 | 1 | 16 | 58 | new | | | | |

| Ab Name | CDR3 (aa) | SEQ ID NO | (+) | Length | Mutations LC | Binding | NEUT | # of Relatives |
|---|---|---|---|---|---|---|---|---|
| 1NC2 | A V Y D S S L S L G L | 725 | 0 | 11 | 47 | | + | 15 |
| 1NC3 | A T Y D S Q R S I R L | 726 | 2 | 11 | 55 | | + | 1 |
| 1NC7 | A T Y D S Q G S T R L | 727 | 1 | 11 | 51 | | + | 1 |
| 1NC9 | A A Y D S T F S L P V | 728 | 0 | 11 | 53 | ? | + | 2 |
| 1NC18 | ND | | | | | | ND | 1 |
| 1NC24 | A A Y D S S L S L R L | 729 | 0 | 11 | 30 | | + | 2 |
| 1NC29 | ND | | | | | | ND | 1 |
| 1NC33 | A T Y D T D L S L R L | 730 | 1 | 11 | 49 | | + | 1 |
| 1NC46 | A A Y D S A V S L P V | 731 | 0 | 11 | 52 | | ND | 1 |
| 1NC48 | A A Y D S T L S L R L | 732 | 1 | 11 | 37 | | ND | 1 |
| 1NC52 | A A Y D S T F S L P V | 733 | 0 | 11 | 54 | | ND | 1 |
| 1NC56 | A T Y D T G L S L R L | 734 | 1 | 11 | 58 | | ND | 1 |
| 1NC60 | A T Y D S G W S I R L | 735 | 1 | 11 | 46 | | + | 3 |
| 1NC66 | A A Y D S T L S L R L | 736 | 1 | 11 | 33 | | ND | 1 |
| 1NC70 | A A Y D S T L S L R L | 737 | 1 | 11 | 40 | | ND | 1 |
| 1NC72 | A T Y D S Q G S T R L | 738 | 1 | 11 | 51 | | + | 2 |
| 1NC94 | A T Y D S D G S I R L | 739 | 1 | 11 | 41 | | − | 5 |
| 1NC95 | ND | | | | | | ND | 1 |
| 1NC107 | A T Y D T G L S L R L | 740 | 1 | 11 | 58 | | ND | 1 |
| 1NC108 | A A F D S A L S L P L | 741 | 0 | 11 | 51 | | + | 1 |
| 1NC109 | ND | | | | | | ND | 1 |
| 1NC110 | ND | | | | | | ND | 1 |
| 1NC116 | ND | | | | | | ND | 1 |
| 1NC118 | A T Y D T G L S L R L | 742 | 1 | 11 | 54 | | ND | 1 |
| 1NC122 | G T Y D T S L S L R L | 743 | 1 | 11 | 57 | | ND | 1 |

TABLE 3-continued

| Ab Name | CDR3 | SEQ ID | col4 | col5 | col6 | col7 | col8 | col9 |
|---|---|---|---|---|---|---|---|---|
| 1NC123 | A T Y D S H G S I R L | 744 | 2 | 11 | 48 | | – | 1 |
| 1NC127 | A T Y D S D G S I R L | 745 | 1 | 11 | 41 | ? | + | 5 |
| 1B344 | A T Y D S G W S I R L | 746 | 1 | 11 | 46 | | + | 1 |
| 1B2416 | ND | | | | | | ND | 1 |
| 1B2503 | G T Y D S Q G S T R L | 882 | 1 | 11 | 49 | | ND | 1 |
| 1B2573 | ND | | | | | | – | 2 |
| 1NC5 | Q H R S N W P W T | 883 | 2 | 9 | | CD4BS | + | 1 |
| 1NC126 | ND | | | | | | ND | 1 |
| 1NC16 | Q Q S F A V P Y T | 884 | 0 | 9 | 35 | ND | ND | 1 |
| 1NC21 | ND | | | | | | ND | ND | 1 |
| 1NC54 | ND | | | | | | ND | ND | 1 |
| 1NC57 | ND | | | | | | ND | ND | 1 |
| 1NC115 | ND | | | | | | ND | ND | 1 | c

| Ab Name | VH | D | JH | (–) | CDR3 (aa) | SEQ ID NO |
|---|---|---|---|---|---|---|
| 8ANC13 | 1-46 | 3-16 | 6 | 4 | D G L G E V A P D Y R Y G I D V | 885 |
| 8ANC22 | 1-46 | 3-16 | 6 | 3 | D G L G E V A P A Y L Y G I D A | 747 |
| 8ANC26 | 1-46 | 3-16 | 6 | 3 | D G L G E V A P A Y L Y G I D A | 748 |
| 8ANC37 | 1-46 | 3-16 | 6 | 3 | D G L G E V A P A Y L Y G I D A | 749 |
| 8ANC41 | 1-46 | 3-16 | 6 | 3 | D G L G E L A P A Y H Y G I D V | 750 |
| 8ANC50 | 1-46 | 3-16 | 6 | 3 | D G L G E L A P A Y Q Y G I D V | 751 |
| 8ANC88 | 1-46 | 3-16 | 6 | 4 | D G L G E V A P D Y R Y G I D V | 752 |
| 8ANC127 | 1-46 | 3-16 | 6 | 3 | D G L G E V A P A Y L Y G I D A | 753 |
| 8ANC131 | 1-46 | 3-16 | 6 | 3 | D G L G E V A P D Y R Y G I D V | 754 |
| 8ANC142 | 1-69 | 3-3 | ND | 2 | T S T Y D Q W S G L H H D G V M A F S S | 755 |
| 8ANC46 | 1-69 | 3-22/2-15 | 3 | 2 | S S G N F E F A F E I | 756 |
| 8ANC191 | 1-69 | 3-22/2-15 | 3 | 2 | S S G N Y D F A Y D I | 757 |
| 8ANC196 | 1-69 | 3-22/2-15 | 3 | 2 | S S G N Y D F A F D I | 758 |
| 8ANC14 | 1-24 | 6-13/5-5 | 4 | 4 | A D R F K V A Q D E G L F V I F D Y | 759 |
| 8ANC34 | 1-24 | 6-13/5-5 | 4 | 4 | A D P F K V A Q D E G L Y V I F D Y | 760 |
| 8ANC58 | 1-24 | 6-13/5-5 | 4 | 4 | A D P F K V A Q D E G L Y V I F D Y | 761 |
| 8ANC168 | 1-24 | 6-13/5-5 | 4 | 4 | A D P F K V A Q D E G L F V I F D Y | 762 |
| 8ANC5 | 1-69 | 4-17/3-10 | 6 | 8 | D R G D T R L L D Y G D Y E D E R Y Y Y G M D V | 763 |
| 8ANC7 | 1-69 | 4-17/3-10 | 6 | 8 | D R G D T R L L D Y G D Y E D E R Y Y Y G M D V | 764 |
| 8ANC9 | 1-69 | 4-17/3-10 | 6 | 8 | D R G D T R L L D Y G D Y E D E R Y Y Y G M D V | 765 |
| 8ANC77 | 1-69 | 4-17/3-10 | 6 | 8 | D R G D T R L L D Y G D Y E D E R Y Y Y G M D V | 766 |
| 8ANC107 | 1-69 | 4-17/3-10 | 6 | 8 | D R G D T R L L D Y G D Y E D E R Y Y Y G M D V | 767 |
| 8ANC108 | 1-69 | 4-17/3-10 | 6 | 8 | D R G D T R L L D Y G D Y E D E R Y Y Y G M D V | 768 |
| 8ANC137 | 1-69 | 4-17/3-10 | 6 | 8 | D R G D T R L L D Y G D Y E D E R Y Y Y G M D V | 769 |

TABLE 3-continued

| Ab Name | | | | CDR3 | | | | | | | SEQ ID NO |
|---|---|---|---|---|---|---|---|---|---|---|---|
| 8ANC16 | 1-69 | 2-2 | 3 | 2 | D R S S A I G Y C S S I S C Y K G S F D I | | | | | | 770 |
| 8ANC24 | 1-24 | 2-2 | 6 | 1 | G G L Y C S S I S C I M D V | | | | | | 771 |
| 8ANC25 | 1-24 | 2-2 | 6 | 1 | G G L Y C S S I S C I M D V | | | | | | 772 |
| 8ANC38 | 3-43 | 3-16 | 5 | 1 | N G F D V | | | | | | 773 |

| Ab Name | (+) | Length | Mutations HC | Primer Set | k/l | Vk/l | Jk/l | (-) |
|---|---|---|---|---|---|---|---|---|
| 8ANC13 | 1 | 16 | 75 | new | k | 3-11 | 2/3 | 1 |
| 8ANC22 | 0 | 16 | 85 | new | | | | |
| 8ANC26 | 0 | 16 | 76 | new | k | 3-11 | 2/3 | 1 |
| 8ANC37 | 0 | 16 | 82 | new | k | 3-11 | 2/3 | 1 |
| 8ANC41 | 1 | 16 | 71 | new | k | 3-11 | 2/3 | 1 |
| 8ANC50 | 0 | 16 | 71 | new | k | 3-11 | 2/3 | 1 |
| 8ANC88 | 0 | 16 | 73 | new | k | 3-11 | 2/3 | 1 |
| 8ANC127 | 0 | 16 | 86 | new | | | | |
| 8ANC131 | 1 | 16 | 75 | new | k | 3-11 | 2/3 | 1 |
| 8ANC142 | 2 | 20 | 72 | new | k | 1-5 | 1/5 | 1 |
| 8ANC46 | 0 | 11 | 30 | old | l | 1-40 | 3 | 1 |
| 8ANC191 | 0 | 11 | 28 | old | | | | |
| 8ANC196 | 0 | 11 | 25 | old | | | | |
| 8ANC14 | 1 | 18 | 11 | old | k | 3-11 | 4 | 0 |
| 8ANC34 | 0 | 18 | 10 | new | | | | |
| 8ANC58 | 0 | 18 | 18 | new | | | | |
| 8ANC168 | 1 | 18 | 11 | new | | | | |
| 8ANC5 | 3 | 24 | 40 | old | k | 1D-33 | 2 | 0 |
| 8ANC7 | 3 | 24 | 37 | new | | | | |
| 8ANC9 | 3 | 24 | 35 | old | | | | |
| 8ANC77 | 3 | 24 | 50 | old | | | | |
| 8ANC107 | 3 | 24 | 38 | old | | | | |
| 8ANC108 | 3 | 24 | 37 | old | | | | |
| 8ANC137 | 3 | 24 | 37 | new | | | | |
| 8ANC16 | 1 | 21 | 12 | old | k | 3-15 | 2 | 0 |
| 8ANC24 | 0 | 14 | 12 | old | k | 3-15 | 1 | 0 |
| 8ANC25 | 0 | 14 | 6 | old | | | | |
| 8ANC38 | 0 | 5 | 70 | new | l | 2-11 | 3 | 0 |

| Ab Name | CDR3 (aa) | SEQ ID NO | (+) | Length | Mutations LC | Binding | NEUT | # of Relatives |
|---|---|---|---|---|---|---|---|---|
| 8ANC13 | Q E Y S S T P Y N | 774 | 0 | 9 | 50 | | + | 1 |
| 8ANC22 | ND | | | | | | ND | 1 |
| 8ANC26 | Q E Y S S T P Y N | 775 | 0 | 9 | 55 | CD4BS | + | 2 |
| 8ANC37 | Q E Y S S T P Y N | 776 | 0 | 9 | 50 | CD4BS | + | 8 |
| 8ANC41 | Q E Y S S T P Y N | 777 | 0 | 9 | 42 | | + | 2 |

TABLE 3-continued

| | | | | | | | | |
|---|---|---|---|---|---|---|---|---|
| 8ANC50 | Q E Y S S T P Y N | 778 | 0 | 9 | 46 | CD4BS | + | 2 |
| 8ANC88 | Q E Y S S T P Y N | 779 | 0 | 9 | 46 | | ND | 1 |
| 8ANC127 | ND | | | | | | ND | 1 |
| 8ANC131 | Q E Y S S T P Y N | 780 | 0 | 9 | 45 | CD4BS | + | 1 |
| 8ANC142 | Q Q Y D T Y P G T | 781 | 0 | 9 | 43 | ? | + | 2 |
| 8ANC46 | Q S Y D R S L R G S V | 782 | 1 | 11 | 30 | ND | ND | 1 |
| 8ANC191 | ND | | | | | | ND | 1 |
| 8ANC196 | ND | | | | | | ND | 1 |
| 8ANC14 | Q Q R A N W R L L T | 783 | 2 | 10 | 9 | CD4i | + | 2 |
| 8ANC34 | ND | | | | | | ND | 5 |
| 8ANC58 | ND | | | | | | ND | 3 |
| 8ANC168 | ND | | | | | | ND | 1 |
| 8ANC5 | Q Q Y S N L P Y T | 784 | 0 | 9 | 17 | CD4i | - | 2 |
| 8ANC7 | ND | | | | | | ND | 2 |
| 8ANC9 | ND | | | | | | ND | 1 |
| 8ANC77 | ND | | | | | | ND | 3 |
| 8ANC107 | ND | | | | | | ND | 2 |
| 8ANC108 | ND | | | | | | ND | 4 |
| 8ANC137 | ND | | | | | | ND | 1 |
| 8ANC16 | Q Q Y Y Q W L S Y T | 785 | 0 | 10 | 13 | ND | ND | 8 |
| 8ANC24 | Q Q Y N H W P Q T | 786 | 0 | 9 | 7 | CD4i | + | 1 |
| 8ANC25 | ND | | | | | | ND | 1 |
| 8ANC38 | C L K K T S S Y V | 787 | 2 | 9 | 41 | CORE | + | 2 | d

| Ab Name | VH | D | JH | (-) | CDR3 (aa) | SEQ ID NO |
|---|---|---|---|---|---|---|
| 12A1 | 1-2 | 5-12/3-10 | 4/5 | 4 | D E S G D D L K W H L H P | 886 |
| 12A2 | 1-2 | 4-17 | 4/5 | 3 | D G S G D D T S W H L H P | 788 |
| 12A4 | 1-2 | 5-12/3-10 | 4/5 | 4 | D E S G D D L K W H L H P | 789 |
| 12A6 | 1-2 | 1-26/3-10 | 4/5 | 2 | D G S G D A T S W H L H P | 790 |
| 12A7 | 1-2 | 1-26 | 4/5 | 4 | D G S G D A R D W H L D P | 791 |
| 12A9 | 1-2 | 3-3 | 4/5 | 5 | D R R D D D R A W L L D P | 792 |
| 12A12 | 1-2 | 1-26/3-10 | 4/5 | 4 | D G S G D D T S W H L D P | 793 |
| 12A13 | 1-2 | 1-26 | 4/5 | 4 | D G S G D D T S W Y L D P | 794 |
| 12A20 | 1-2 | 1-26 | 4/5 | 3 | D G S G D A R D W H L H P | 795 |
| 12A22 | 1-2 | 3-16 | 4/5 | 4 | D G G G D D R T W L L D A | 796 |

TABLE 3-continued

| | | | | | | | |
|---|---|---|---|---|---|---|---|
| 12A23 | 1-2 | 3-3 | 4/5 | 5 | D R R D D G L D W L L D P | 797 | |
| 12A27 | 1-2 | 1-26/3-10 | 4/5 | 3 | D G S G D D T S W H L H P | 798 | |
| 12A46 | 1-2 | 3-10 | 4/5 | 1 | G G G D G R N W H L H P | 799 | |
| 12A55 | 1-2 | 1-26 | 4/5 | 4 | D G S G D D R N W H L D P | 800 | |
| 12A56 | 1-2 | 1-26 | 4/5 | 4 | D E S G Y D L N W H L D S | 801 | |

| Ab Name | (+) | Length | # Mutations HC | Primer Set | k/l | Vk/l | Jk/l | (−) |
|---|---|---|---|---|---|---|---|---|
| 12A1 | 2 | 13 | 60 | new | k | 1D-33 | 3 | 0 |
| 12A2 | 2 | 13 | 67 | new | k | 1D-33 | 3 | 10 |
| 12A4 | 2 | 13 | 59 | new | k | 1D-33 | 3 | 0 |
| 12A6 | 2 | 13 | 61 | new | k | 1D-33 | 3 | 1 |
| 12A7 | 1 | 13 | 62 | new | k | 1D-33 | 3 | 1 |
| 12A9 | 3 | 13 | 62 | new | k | 1D-33 | 3 | 1 |
| 12A12 | 1 | 13 | 60 | new | k | 1D-33 | 3 | 1 |
| 12A13 | 0 | 13 | 61 | new | k | 1D-33 | 3 | 1 |
| 12A20 | 3 | 13 | 61 | new | k | 1D-33 | 3 | 1 |
| 12A22 | 1 | 13 | 61 | new | k | 1D-33 | 3 | 1 |
| 12A23 | 2 | 13 | 51 | new | k | 1D-33 | 3 | 1 |
| 12A27 | 2 | 13 | 68 | new | k | 1D-33 | 3 | 1 |
| 12A46 | 3 | 13 | 62 | new | k | 1D-33 | 3 | 1 |
| 12A55 | 1 | 13 | 63 | new | k | 1D-33 | 3 | 2 |
| 12A56 | 1 | 13 | 66 | new | k | 1D-33 | 3 | 1 |

| Ab Name | CDR3 (aa) | SEQ ID NO | (+) | Length | Mutations LC | Binding | NEUT | # of Relatives |
|---|---|---|---|---|---|---|---|---|
| 12A1 | A A F Q W | 887 | 0 | 5 | 39 | | ND | 1 |
| 12A2 | A V L E F | 802 | 0 | 5 | 44 | | + | 3 |
| 12A4 | A V F Q W | 803 | 0 | 5 | 36 | CD4BS | + | 3 |
| 12A6 | A V L E F | 804 | 0 | 5 | 39 | | + | 1 |
| 12A7 | A V L E F | 805 | 0 | 5 | 41 | | ND | 2 |
| 12A9 | Q L F E F | 806 | 0 | 5 | 39 | | ND | 1 |
| 12A12 | A V L E F | 807 | 0 | 5 | 41 | CD4BS | + | 1 |
| 12A13 | A V V E F | 808 | 0 | 5 | 41 | | ND | 1 |
| 12A20 | A A L E F | 809 | 0 | 5 | 40 | | + | 1 |
| 12A22 | S V Y E F | 810 | 0 | 5 | 39 | | + | 2 |
| 12A23 | Q L F E F | 811 | 0 | 5 | 39 | | + | 1 |
| 12A27 | A V L E F | 812 | 0 | 5 | 40 | | ND | 1 |
| 12A46 | A S L E F | 813 | 0 | 5 | 43 | | + | 1 |
| 12A55 | E V Y E F | 814 | 0 | 5 | 37 | | + | 1 |
| 12A56 | E S F Q W | 815 | 0 | 5 | 37 | | ND | 1 |

TABLE 3-continued

| Ab Name | VH | D | JH | (-) | CDR3 (aa) | SEQ ID NO |
|---|---|---|---|---|---|---|
| 3B191 | 1-2 | 6-25/6-13/6-6 | 2/6 | 3 | Q R S D Y W D F D V | 816 |
| 3B6 | 4-39 | 3-9/3-10 | 3 | 2 | I P Y H S E S Y Y K V V I G G F D V | 817 |
| 3B8 | 1-69 | 4-17/3-22 | 4 | 3 | D H G D P R T G Y Y F D Y | 818 |
| 3B27 | 3-64 | 3-9/1-26/4-17 | 5 | 1 | G P L L R Y L D S | 819 |
| 3B41 | 1-24 | 3-16 | 6 | 4 | K A K D Y Y Y E S S D Y S P Y Y Y Y Y M D V | 820 |
| 3B46 | 4-31 | 3-3/2-8 | 4/5 | 0 | G S G R W T I G A R I Y F D N | 821 |
| 3B144 | 3-30 | 3-3/3-10/3-16 | 4/5 | 2 | T P P H Y D V L T G Y P S S V L E F | 822 |
| 3B117 | 1-69 | 5-5/5-18/5-24 | 3 | 2 | A T G Y S Y G Y L D A F D I | 823 |
| 3A869 | 4-4/4-59 | 6-19/5-12/1-26 | 4 | 2 | E K G Q W L T V P P Y Y F D S | 824 |
| 3A228 | 5-51 | 3-3/2-2 | 6 | 1 | T R C F G A N C F N F M D V | 825 |
| 3A461 | 1-46 | 2-2 | 4 | 1 | P E P S S I V A P L Y Y | 826 |
| 3A18 | 1-69 | 3-10/5-24 | 3 | 3 | D P Q V E V R G N A F D I | 827 |
| 3A125 | 1-46 | 1-20/1-7/3-10 | 3 | 2 | P Q Y N L G R D P L D V | 828 |
| 3A255 | 4-59 | 3-3/3-9 | 4 | 3 | A D Y D L L T S S Y H F D S | 829 |
| 3A233 | 4-59/4-61 | 3-3/4-17 | 4/5 | 3 | L D G E A F R Y Y L D L | 830 |

| Ab Name | (+) | Length | # Mutations HC | Primer Set | k/l | Vk/l | Jk/l | (-) |
|---|---|---|---|---|---|---|---|---|
| 3B191 | 1 | 10 | 81 | new | k | 1D-33 | 3 | 1 |
| 3B6 | 1 | 18 | 50 | new | k | 1-9 | 1/3 | 0 |
| 3B8 | 2 | 13 | 50 | new | k | 3-20 | 1/5 | 2 |
| 3B27 | 0 | 9 | 18 | old | k | 3-11 | 1/5 | 0 |
| 3B41 | 2 | 22 | 17 | old | k | 3-20 | 2 | 0 |
| 3B46 | 2 | 15 | 22 | old | k | 3-20 | 1/4 | 0 |
| 3B144 | 1 | 18 | 23 | old | k | 3-15 | 1/5 | 0 |
| 3B117 | 0 | 14 | 22 | new | l | 1-44 | 1 | 2 |
| 3A869 | 1 | 1 | 33 | old | k | 1D-39 | 5 | 0 |
| 3A228 | 1 | 1 | 34 | old | k | 4-1 | 3 | 0 |
| 3A461 | 0 | 1 | 15 | old | k | 3-20 | 1 | 0 |
| 3A18 | 1 | 1 | 40 | old | k | 1D-39 | 5 | 0 |
| 3A125 | 1 | 1 | 22 | old | k | 3-20 | 1 | 0 |
| 3A255 | 1 | 1 | 35 | old | l | 7-43 | 3 | 0 |
| 3A233 | 1 | 1 | 32 | old | l | 2-14 | 2/3 | 0 |

| Ab Name | CDR3 (aa) | SEQ ID NO | (+) | Length | Binding | NEUT | # of Relatives |
|---|---|---|---|---|---|---|---|
| 3B191 | Q V Y E F | 831 | 0 | 5 | CD4BS | + | 7 |
| 3B6 | Q Q L A T | 832 | 0 | 5 | GP41 | + | 11 |
| 3B8 | Q Q Y D D A P I T | 833 | 0 | 9 | GP41 | − | 9 |

TABLE 3-continued

| | | | | | | | |
|---|---|---|---|---|---|---|---|
| 3B27 | Q H R T N W P P S I T | 834 | 2 | 11 | CD4i | − | 3 |
| 3B41 | Q Q Y G T S S C T | 835 | 0 | 9 | CD4i | − | 2 |
| 3B46 | Q Q Y G S S P P T | 836 | 0 | 9 | GP41 | ND | 2 |
| 3B144 | Q Q Y N N W P P I T | 837 | 0 | 10 | ND | ND | 4 |
| 3B117 | A A W D D T L Y V | 838 | 0 | 9 | ND | ND | 1 |
| 3A869 | Q Q S H S P S | 839 | 1 | 7 | CD4BS | + | 1 |
| 3A228 | Q Q Y Y I S P | 840 | 0 | 7 | VAR | + | 4 |
| 3A461 | Q Q Y G T L H P R T | 841 | 2 | 10 | GP41 | − | 3 |
| 3A18 | Q Q T Y T S P I T | 842 | 0 | 9 | GP41 | − | 2 |
| 3A125 | Q Q Y G L S P W T | 843 | 0 | 9 | GP41 | − | 4 |
| 3A255 | L L L P Y Y G G P W I | 844 | 0 | 11 | GP41 | − | 2 |
| 3A233 | S S F T P T N T L V | 845 | 0 | 10 | GP41 | − | 2 | f

| Ab Name | VH | D | JH | (−) | CDR3 (aa) | SEQ ID NO |
|---|---|---|---|---|---|---|
| 1B2434 | 15341 | 3-22/5-5 | 1 | 4 | N E A D Y H D G N H S L R G M F D Y | 846 |
| 1B218 | 1-69 | 3-3 | 3 | 1 | G R Q T F R A I W S G P P V V F D I | 847 |
| 1B331 | 4-34 | 3-9/3-3 | 6 | 3 | R Y F D W S P F R R D T Y G T D V | 848 |
| 1B2174 | 4-34 | 3-9/3-3 | 6 | 3 | R Y L D W S P I G R D T Y G T D V | 849 |
| 1B2055 | 1-69 | 2-21 | 2/5 | 1 | G L C R G G N C R L G P S G W L D P | 850 |
| 1B2133 | 1-3 | 4-17/2-21 | 4 | 1 | V A Y V H V V T T R S L D N | 851 |
| 1A64 | 4-59 | 5-5/5-18 | 6 | 2 | H E A P R Y S Y A F R R Y Y H Y G L D V | 852 |
| 1A621 | 4-59 | 3-3/3-9 | 6 | 1 | V I S G R I T I F Y Y N Y I D V | 853 |
| 1A577 | 3-48 | 3-10/3-16 | 1 | 3 | G T L W F G E S G L R L D H | 854 |
| 1A732 | 3-7/3-73 | 3-22/3-10 | 6 | 2 | N R R V A M P E A M I L S F Y M D V | 855 |
| 1A74 | 4-34 | 3-3/3-9 | 4 | 1 | V V P M F S I F G V V K A N Y F D Y | 856 |
| 1A695 | 4-59 | 3-3/3-9 | 3 | 2 | A G L D Y N F W N G K G R K G A F D V | 857 |
| 1A479 | 1-69 | 3-22 | 4 | 1 | G F R G S P F S S G S L Y F D S | 858 |
| 1A182 | 1-69 | 4-17/1-26 | 6 | 6 | A V I T D L H T F G D Y E L E D P S Y Y Y M D V | 859 |
| 1A 693 | 3-23 | 7-27/3-22 | 4 | 1 | R G R R Q I G D Y | 860 |
| 1A 79 | 5-51 | 3-9/3-3 | 3 | 4 | S Y Y D F S I G D G N D A F D V | 861 |
| 1A 27 | 3-11 | 3-6/5-5 | 5 | 2 | D T T T F T T F G G G P N M G G F D P | 862 |

| Ab Name | (+) | Length | # Mutations HC | Primer Set | k/l | Vk/l | Jk/l | (−) |
|---|---|---|---|---|---|---|---|---|
| 1B2434 | 2 | 19 | 74 | new | l | 1-47 | 3 | 1 |
| 1B218 | 2 | 18 | 47 | new | k | 3-11 | 2 | 0 |
| 1B331 | 3 | 17 | 40 | new | k | 4-1 | 1/4 | 0 |
| 1B2174 | 2 | 17 | 41 | new | k | 4-1 | 1/4 | 0 |
| 1B2055 | 2 | 18 | 62 | new | k | 3-15 | 1 | 2 |
| 1B2133 | 1 | 14 | 22 | new | k | 1D-39 | 1 | 0 |

TABLE 3-continued

| | | | | | | | | |
|---|---|---|---|---|---|---|---|---|
| 1A64 | 5 | 20 | 20 | old | l | 1-44 | 3 | 2 |
| 1A621 | 1 | 16 | 30 | old | l | 1-47 | 3 | 1 |
| 1A577 | 1 | 14 | 15 | old | k | 1-16 | 2 | 0 |
| 1A732 | 2 | 18 | 9 | old | k | 3-20 | 3 | 0 |
| 1A74 | 1 | 18 | 23 | old | l | 1-51 | 3 | 1 |
| 1A695 | 3 | 19 | 9 | old | k | 1-5 | 1 | 1 |
| 1A479 | 1 | 16 | 25 | old | k | 3-20 | 1 | 0 |
| 1A182 | 1 | 24 | 28 | old | k | 1-5 | 1 | 0 |
| 1A693 | 3 | 9 | 17 | old | k | 1D-39 | 2 | 0 |
| 1A79 | 0 | 16 | 30 | old | l | 1-47 | 1 | 3 |
| 1A27 | 0 | 19 | 50 | old | | 1-9 | 1 | 0 |

| Ab Name | CDR3 (aa) | SEQ ID NO | (+) | Length | Binding | NEUT | # of Relatives |
|---|---|---|---|---|---|---|---|
| 1B2434 | A V Y D S S L S L G L | 863 | 0 | 11 | CD4BS | + | 7 |
| 1B218 | Q H R S N W P W T | 864 | 2 | 9 | CD4BS | + | 10 |
| 1B331 | H Q Y F S T P R T | 865 | 2 | 9 | CORE | + | 4 |
| 1B2174 | H Q Y F N T P R T | 866 | 2 | 9 | | ND | 1 |
| 1B2055 | Q Q Y E D P P W T | 867 | 0 | 9 | ND | ND | 3 |
| 1B2133 | Q Q T Y S N P R M | 868 | 1 | 9 | CD4i | − | 2 |
| 1A64 | A S W D D S L S G W V | 869 | 0 | 11 | CD4BS | + | 24 |
| 1A621 | A S W D N S L S G P V | 870 | 0 | 11 | CD4BS | + | 3 |
| 1A577 | Q Q Y N S F P PT | 871 | 0 | 9 | CD4BS | + | 8 |
| 1A732 | Q Q Y G R S P | 872 | 1 | 7 | CD4BS | + | 1 |
| 1A74 | G T W D S S L S A V L | 873 | 0 | 11 | CORE | + | 2 |
| 1A695 | Q Q Y D S | 874 | 0 | 5 | CORE | + | 2 |
| 1A479 | H Q Y A Y S P R T | 875 | 2 | 9 | CORE | + | 11 |
| 1A182 | Q Q Y K S Y S G T | 876 | 0 | 9 | CD4i | + | 3 |
| 1A693 | Q H S F G S P P W T | 877 | 1 | 11 | CD4i | − | 1 |
| 1A79 | A A W D D S F D Y V | 878 | 0 | 10 | V3 | + | 27 |
| 1A27 | Q Q L R T | 879 | 1 | 5 | GP41 | − | 8 |

TABLE 4

| | Patient 3, Clone RU01[a] | | | | | |
|---|---|---|---|---|---|---|
| | 3BNC62 | 3BNC176 | 3BNC60 | 3BNC117 | 3BNC95 | 3BNC104 |
| MW965.26 | <0.09 | <0.10 | <0.04 | <0.09 | <0.07 | >50 |
| BaL.26 | <0.09 | <0.10 | <0.04 | <0.09 | <0.07 | 0.025 |
| DJ263.8 | <0.09 | <0.10 | <0.04 | <0.09 | <0.07 | 0.054 |
| 6535.3 | 0.68 | 0.46 | 0.54 | 0.55 | 1.0 | >50 |
| RHPA4259.7 | <0.09 | <0.10 | <0.05 | 0.041 | <0.07 | 0.0252 |
| TRO.11 | <0.09 | <0.10 | <0.05 | 0.077 | <0.07 | 3.791 |
| PVO.4 | <0.09 | <0.10 | 0.09 | <0.09 | <0.07 | 0.348 |
| YU2.DG | <0.09 | <0.10 | <0.05 | 0.054 | <0.07 | 0.034 |

TABLE 4-continued

Patient 3, Clone RU01

|  | 3BNC91 | 3BNC55 | 3BNC89 | 3ANC3 | 3BNC53 | 3BNC72 |
|---|---|---|---|---|---|---|
| MW965.26 | <0.08 | 0.04 | >0.05 | 0.18 | 0.09 | <0.06 |
| BaL.26 | >178 | >30 | >110 | >50 | >30 | >139 |
| DJ263.8 | >178 | >30 | >110 | >50 | >30 | >139 |
| 6535.3 | 1 | 2.6 | 1.7 | >50 | 13.6 | 8.49 |
| RHPA4259.7 | <0.08 | 2.2 | 12.4 | 7.66 | 100.6 | >139 |
| TRO.11 | 3.06 | 18.4 | 52.4 | 10.76 | >155 | >139 |
| PVO.4 | 0.44 | 3.9 | 2.7 | 36.77 | >155 | >139 |
| YU2.DG | <0.08 | 0.9 | 0.39 | 35.01 | >155 | >139 |

Patient 3, Clone RU01

|  | 3BNC156 | 3BNC158 | 3BNC153 | 3BNC108 |
|---|---|---|---|---|
| MW965.26 | 0.08 | 0.11 | 0.15 | ND |
| BaL.26 | >111 | >109 | >100 | 20.6 |
| DJ263.8 | >111 | >109 | >100 | >55 |
| 6535.3 | 11.1 | 9.9 | 28.9 | >55 |
| RHPA4259.7 | >111 | >109 | >100 | 45.91 |
| TRO.11 | >111 | >109 | >100 | >55 |
| PVO.4 | >111 | >109 | >100 | >55 |
| YU2.DG | >111 | >109 | >100 | 25.5 |

Patient 3, Clone RU01

|  | 3BNC142 | 3BNC66 | 3BNC42 | 3BNC102 |
|---|---|---|---|---|
| MW965.26 | 0.14 | 1.24 | ND | >50 |
| BaL.26 | >172 | >189 | >26 | >50 |
| DJ263.8 | >172 | >189 | >26 | >50 |
| 6535.3 | >172 | >189 | >26 | >50 |
| RHPA4259.7 | >172 | >189 | >26 | >50 |
| TRO.11 | >172 | >189 | >26 | >50 |
| PVO.4 | >172 | >189 | NF | >50 |
| YU2.DG | >172 | >189 | >26 | >50 |

Patient 3 Clones RU02-07

|  | 3A67 | 3A383 | 3BNC8 | 3ANC44 | 3A576 | 3ANC38 |
|---|---|---|---|---|---|---|
| MW965.26 | 0.1 | 0.5 | 0.74 | 25.49 | >50 | >50 |
| BaL.26 | 19.2 | 5.3 | >50 | 27.91 | 27 | >50 |
| DJ263.8 | >50 | >50 | >50 | >50 | >50 | >50 |
| 6535.3 | >50 | ND | >50 | >50 | >50 | >50 |
| RHPA4259.7 | >50 | ND | >50 | >50 | >50 | >50 |
| TRO.11 | >50 | ND | >50 | >50 | >50 | >50 |
| PVO.4 | >50 | ND | >50 | >50 | >50 | >50 |
| YU2.DG | >50 | ND | >50 | >50 | >50 | >50 |

B12 and NIH 45 Clone

|  | B12 | VRC01 | NIH45-46 |
|---|---|---|---|
| MW965.26 | 0.2 | <0.08 | 0.04 |
| BaL.26 | 0.2 | 0.1 | <0.04 |
| DJ263.8 | >50 | 0.08 | <0.04 |
| 6535.3 | 1.4 | 0.539 | 0.14 |
| RHPA4259.7 | 0.1 | 0.06 | 0.034 |
| TRO.11 | >50 | 0.2 | 1.9 |
| PVO.4 | >50 | 0.2 | 0.17 |
| YU2.DG | 2.2 | 0.12 | <0.05 | b
Patient 1, Clone RU08

|  | 1B2640 | 1B2530 | 1B2364 | 1NC2 | 1NC9 | 1B2490 |
|---|---|---|---|---|---|---|
| MW965.26 | 41.76 | 0.762 | 1.85 | >50 | >50 | >50 |
| BaL.26 | 0.08 | >50 | >25 | 0.11 | 1.37 | 0.058 |
| DJ263.8 | >50 | 2.71 | 3.75 | >50 | >50 | >50 |
| 6535.3 | >50 | >50 | >25 | >50 | >50 | >50 |
| RHPA4259.7 | 0.04 | 3.6 | 2.18 | 0.59 | 0.09 | 0.414 |
| TRO.11 | 0.23 | 0.516 | 0.27 | 0.17 | 0.2 | 1.06 |
| PVO.4 | 1.05 | 0.275 | 0.161 | 0.37 | 0.34 | 2.97 |
| YU2.DG | 0.2 | 0.209 | 2.46 | 0.12 | 0.13 | 0.125 |

TABLE 4-continued

Patient 1, Clone RU08

|  | 1B2351 | 1B344 | 1NC24 | 1NC3 | 1NC7 | 1NC33 |
|---|---|---|---|---|---|---|
| MW965.26 | >50 | >50 | >50 | >25 | >50 | >50 |
| BaL.26 | >50 | >50 | >50 | >25 | >50 | >50 |
| DJ263.8 | 8.46 | 12.62 | >50 | >25 | >50 | >50 |
| 6535.3 | >50 | >50 | >50 | >25 | >50 | 22.04 |
| RHPA4259.7 | 36.48 | 29.98 | >50 | >25 | 34.27 | >50 |
| TRO.11 | 0.331 | 0.27 | 0.2 | 3.37 | 16.57 | >50 |
| PVO.4 | 0.25 | 0.27 | 0.19 | 6.68 | 1.39 | 1.84 |
| YU2.DG | 0.058 | 0.25 | 0.16 | 18.26 | >50 | >50 |

Patient 1, Clone RU08

|  | 1NC108 | 1B2644 | 1B2339 | 1NC123 |
|---|---|---|---|---|
| MW965.26 | >50 | >25 | >25 | >50 |
| BaL.26 | >50 | >25 | >25 | >50 |
| DJ263.8 | >50 | >25 | >25 | >50 |
| 6535.3 | >50 | >25 | >25 | >50 |
| RHPA4259.7 | >50 | >25 | >25 | >50 |
| TRO.11 | 19.37 | >25 | >25 | >50 |
| PVO.4 | 3.13 | >25 | >25 | >50 |
| YU2.DG | >50 | >25 | >25 | >50 |

Patient 1, Clone RU09

|  | 1B218 |
|---|---|
| MW965.26 | >119 |
| BaL.26 | 1.1 |
| DJ263.8 | >119 |
| 6535.3 | 3.6 |
| RHPA4259.7 | >100 |
| TRO.11 | >100 |
| PVO.4 | >100 |
| YU2.DG | >100 | c
Patient 8, Clone RU10

|  | 8ANC192 | 8ANC134 | 8ANC13 | 8ANC131 | 8ANC182 | 8ANC50 | 8ANC45 |
|---|---|---|---|---|---|---|---|
| MW965.26 | >73 | >50 | >50 | >50 | >115 | >50 | >50 |
| BaL.26 | 0.08 | 0.02 | 0.04 | 0.06 | 0.08 | 0.17 | 0.296 |
| DJ263.8 | <0.03 | 0.003 | 0.008 | 0.004 | <0.05 | 0.04 | 0.041 |
| 6535.3 | 0.34 | 0.06 | 0.27 | 0.2 | 0.89 | 2.27 | 0.813 |
| RHPA4259.7 | >50 | >50 | >50 | >50 | >100 | >50 | >50 |
| TRO.11 | >100 | >50 | >50 | >50 | >100 | >50 | >50 |
| PVO.4 | 0.89 | 0.46 | 0.63 | 0.81 | 1.2 | 3.89 | 4.259 |
| YU2.DG | 0.09 | 0.15 | 0.21 | 0.18 | 0.22 | 0.42 | 0.499 |

Patient 8, Clones RU11-15

|  | 8ANC57 | 8ANC195 | 8ANC24 | 8ANC14 | 8ACN5 |
|---|---|---|---|---|---|
| MW965.26 | 24.1 | >50 | 0.29 | 2.01 | >50 |
| BaL.26 | 4.35 | >50 | 47.53 | >50 | >50 |
| DJ263.8 | 30.19 | >50 | >50 | >50 | >50 |
| 6535.3 | >103 | 0.2 | >50 | >50 | >50 |
| RHPA4259.7 | 1.65 | 0.34 | >50 | >50 | >50 |
| TRO.11 | 32.07 | 0.18 | >50 | >50 | >50 |
| PVO.4 | 101.15 | 0.52 | >50 | >50 | >50 |
| YU2.DG | 27.52 | 0.79 | >50 | >50 | >50 | d
Patient 12, Clone RU16

|  | 12A12 | 12A21 | 12A4 | 12A37 | 12A22 | 12A16 |
|---|---|---|---|---|---|---|
| MW965.26 | 0.042 | 0.075 | 0.098 | 0.056 | 0.06 | 0.167 |
| BaL.26 | 0.017 | <0.001 | <0.001 | 0.005 | 0.04 | 0.042 |
| DJ263.8 | 0.002 | 0.035 | 0.017 | 0.013 | 0.08 | 0.012 |
| 6535.3 | 21.97 | >50 | >50 | >50 | >25 | 15.44 |
| RHPA4259.7 | 0.086 | 0.038 | 0.041 | 0.042 | 0.04 | 0.207 |
| TRO.11 | 0.288 | 0.164 | 0.257 | 0.827 | 0.56 | 0.751 |
| PVO.4 | 0.928 | 0.584 | 0.819 | 0.516 | 0.45 | 2.44 |
| YU2.DG | 0.084 | 0.015 | 0.018 | 0.019 | 0.11 | 0.234 |

TABLE 4-continued

Patient 12, Clone RU16

|  | 12A20 | 12A6 | 12A23 | 12A46 | 12A55 |
|---|---|---|---|---|---|
| MW965.26 | 0.192 | 0.112 | 5.1 | >50 | 0.58 |
| BaL.26 | 0.035 | 0.072 | 0.57 | 0.013 | 2.87 |
| DJ263.8 | 0.05 | 0.004 | 0.63 | 5.79 | >50 |
| 6535.3 | 48.73 | >24 | 14.73 | 48.85 | >50 |
| RHPA4259.7 | 0.109 | 0.227 | 0.496 | >50 | >50 |
| TRO.11 | 0.689 | 1.52 | 2.88 | >50 | 21.45 |
| PVO.4 | 3.04 | 3.32 | 2.24 | 2.18 | 0.99 |
| YU2.DG | 0.142 | 0.222 | 0.053 | 0.49 | 0.1 |

B12 and NIH45 Clone

|  | B12 | VRC01 | NIH45-46 |
|---|---|---|---|
| MW965.26 | 0.2 | <0.08 | 0.04 |
| BaL.26 | 0.2 | 0.1 | <0.04 |
| DJ263.8 | >50 | 0.08 | <0.04 |
| 6535.3 | 1.4 | 0.539 | 0.14 |
| RHPA4259.7 | 0.1 | 0.06 | <0.05 |
| TRO.11 | >50 | 0.2 | 1.9 |
| PVO.4 | >50 | 0.2 | 0.17 |
| YU2.DG | 2.2 | 0.12 | <0.05 | e
Patient 3, clone RU01

|  | 3BNC62 | 3BNC176 | 3BNC60 | 3BNC117 | 3BNC95 | 3BNC104 |
|---|---|---|---|---|---|---|
| MW965.26 | <0.09 | <0.10 | 0.09 | <0.09 | <0.07 | >50 |
| BaL.26 | <0.09 | <0.10 | <0.04 | <0.09 | <0.07 | 0.09 |
| DJ263.8 | 0.1 | <0.10 | 0.1 | 0.1 | 0.1 | 0.187 |
| 6535.3 | 2.24 | 1.7 | 1.77 | 2.44 | 4.5 | >50 |
| RHPA4259.7 | <0.09 | <0.10 | 0.07 | 0.137 | <0.07 | 0.06 |
| TRO.11 | <0.09 | <0.10 | 0.12 | 0.077 | <0.07 | 30.847 |
| PVO.4 | 0.23 | 0.16 | 0.27 | 0.19 | 0.23 | 0.901 |
| YU2.DG | <0.09 | <0.10 | 0.07 | 0.054 | <0.07 | 0.097 |

Patient 3, clone RU01

|  | 3BNC91 | 3BNC55 | 3BNC89 | 3ANC3 | 3BNC53 | 3BNC72 | 3BNC156 |
|---|---|---|---|---|---|---|---|
| MW965.26 | <0.08 | 0.15 | 0.16 | 0.64 | 0.61 | 0.37 | 0.47 |
| BaL.26 | >178 | >30 | >110 | >50 | >30 | >139 | >111 |
| DJ263.8 | >178 | >30 | >110 | >50 | >30 | >139 | >111 |
| 6535.3 | 6.7 | 5.53 | 5.92 | >50 | 73.38 | 133.665 | 69.66 |
| RHPA4259.7 | 0.52 | 8.03 | >110 | >50 | >155 | >139 | >111 |
| TRO.11 | 32.31 | 41.67 | >110 | >50 | >155 | >139 | >111 |
| PVO.4 | 2.65 | 6.5 | 10.18 | >50 | >155 | >139 | >111 |
| YU2.DG | <0.08 | 1.07 | 1.49 | >50 | >155 | >139 | >111 |

Patient 3, clone RU01

|  | 3BNC158 | 3BNC153 | 3BNC108 | 3BNC142 | 3BNC66 | 3BNC42 | 3BNC102 |
|---|---|---|---|---|---|---|---|
| MW965.26 | 0.6 | 0.63 | ND | 0.8 | 29.98 | ND | >50 |
| BaL.26 | >109 | >100 | >55 | >172 | >189 | >26 | >50 |
| DJ263.8 | >109 | >100 | >55 | >172 | >189 | >26 | >50 |
| 6535.3 | 97.75 | >100 | >55 | >172 | >189 | >26 | >50 |
| RHPA4259.7 | >109 | >100 | >55 | >172 | >189 | >26 | >50 |
| TRO.11 | >109 | >100 | >55 | >172 | >189 | >26 | >50 |
| PVO.4 | >109 | >100 | >55 | >172 | >189 | ND | >50 |
| YU2.DG | >109 | >100 | >55 | >172 | >189 | >26 | >50 |

Patient 3, Clones RU02-07

|  | 3A67 | 3A383 | 3BNC8 | 3ANC44 | 3A576 | 3ANC38 |
|---|---|---|---|---|---|---|
| MW965.26 | 16 | >25 | 0.74 | >50 | >50 | >50 |
| BaL.26 | >50 | >25 | >50 | >50 | >50 | >50 |
| DJ263.8 | >50 | >25 | >50 | >50 | >50 | >50 |
| 6535.3 | >50 | ND | >50 | >50 | >50 | >50 |
| RHPA4259.7 | >50 | ND | >50 | >50 | >50 | >50 |
| TRO.11 | >50 | ND | >50 | >50 | >50 | >50 |
| PVO.4 | >50 | ND | >50 | >50 | >50 | >50 |
| YU2.DG | >50 | ND | >50 | >50 | >50 | >50 |

TABLE 4-continued

B12 and NIH 45 Clone

|        | B12   | VRC01  | 45-46 |
|--------|-------|--------|-------|
| MW965.26   | ND    | <0.08  | 0.21  |
| BaL.26     | ND    | 0.1    | 0.06  |
| DJ263.8    | ND    | 0.553  | 0.06  |
| 6535.3     | ND    | 2.7    | 0.28  |
| RHPA4259.7 | 0.39  | 0.185  | 0.146 |
| TRO.11     | >50   | 0.832  | 9.56  |
| PVO.4      | >50   | 1.2    | 0.47  |
| YU2.DG     | 7.8   | 0.372  | 0.08  | f
Patient 1, Clone RU08

|            | 1B2640 | 1B2530 | 1B2364 | 1NC2  | 1NC9  | 1B2490 | 1B2351 |
|------------|--------|--------|--------|-------|-------|--------|--------|
| MW965.26   | >50    | >50    | >25    | >50   | >50   | >50    | >50    |
| BaL.26     | 0.32   | >50    | >25    | 0.51  | 19.92 | 0.3    | >50    |
| DJ263.8    | >50    | >50    | >25    | >50   | >50   | >50    | >50    |
| 6535.3     | >50    | >50    | >25    | >50   | >50   | >50    | >50    |
| RHPA4259.7 | 0.25   | >50    | >25    | 4.33  | 0.4   | 1.97   | >50    |
| TRO.11     | 1.62   | 2.46   | 1.77   | 0.55  | 0.65  | 3.58   | 1.13   |
| PVO.4      | 2.97   | 1.25   | 0.65   | 1.08  | 1.32  | 10.57  | 0.88   |
| YU2.DG     | 0.7    | 7.74   | >25    | 0.39  | 0.56  | 0.59   | 0.48   |

Patient 1, Clone RU08

|            | 1B344 | 1NC24 | 1NC3 | 1NC7 | 1NC33 | 1NC108 | 1B2644 |
|------------|-------|-------|------|------|-------|--------|--------|
| MW965.26   | >50   | >50   | >25  | >50  | >50   | >50    | >25    |
| BaL.26     | >50   | >50   | >25  | >50  | >50   | >50    | >25    |
| DJ263.8    | >50   | >50   | >25  | >50  | >50   | >50    | >25    |
| 6535.3     | >50   | >50   | >25  | >50  | >50   | >50    | >25    |
| RHPA4259.7 | >50   | >50   | >25  | >50  | >50   | >50    | >25    |
| TRO.11     | 0.89  | 0.66  | >25  | >50  | >50   | >50    | >25    |
| PVO.4      | 0.94  | 0.6   | >25  | 7.17 | 10.12 | 25.08  | >25    |
| YU2.DG     | 1.29  | 0.55  | >25  | >50  | >50   | >50    | >25    |

Patient 1, Clone RU08

|            | 1B2339 | 1NC123 |
|------------|--------|--------|
| MW965.26   | >25    | >50    |
| BaL.26     | >25    | >50    |
| DJ263.8    | >25    | >50    |
| 6535.3     | >25    | >50    |
| RHPA4259.7 | >25    | >50    |
| TRO.11     | >25    | >50    |
| PVO.4      | >25    | >50    |
| YU2.DG     | >25    | >50    |

Patient 1, Clone RU09

|            | 1B218 |
|------------|-------|
| MW965.26   | >119  |
| BaL.26     | 5.61  |
| DJ263.8    | >119  |
| 6535.3     | 35.12 |
| RHPA4259.7 | >100  |
| TRO.11     | >100  |
| PVO.4      | >100  |
| YU2.DG     | >100  | g
Patient 8, Clone RU 10

|            | 8ANC192 | 8ANC134 | 8ANC13 | 8ANC131 | 8ANC182 | 8ANC50 | 8ANC45 |
|------------|---------|---------|--------|---------|---------|--------|--------|
| TRO.11     | >73     | >50     | >50    | >50     | >115    | >50    | >50    |
| BaL.26     | 0.43    | 0.11    | 0.18   | 0.31    | 0.73    | 0.77   | 7.45   |
| DJ263.8    | 0.1     | 0.044   | 0.069  | 0.046   | 0.11    | 0.15   | 0.166  |
| 6535.3     | 1.43    | 2       | 2.3    | 1.9     | 3.93    | 13.65  | 10.473 |
| RHPA4259.7 | >100    | >50     | >50    | >50     | >100    | >50    | >50    |
| TRO.11     | >100    | >50     | >50    | >50     | >100    | >50    | >50    |
| PVO.4      | 3.94    | 2.5     | 3.7    | 4.9     | 4.43    | 14.99  | 17.315 |
| YU2.DG     | 0.51    | 0.616   | 1.07   | 0.92    | 1.46    | 1.59   | 2.942  |

TABLE 4-continued

Patient 8, Clones RU11-15

|  | 8AN57 | 8AN195 | 8AN24 | 8AN14 | 8AN5 |
|---|---|---|---|---|---|
| TRO.11 | >103 | >50 | 0.76 | 6.64 | >50 |
| BaL.26 | 24.76 | >50 | >50 | >50 | >50 |
| DJ263.8 | >103 | >50 | >50 | >50 | >50 |
| 6535.3 | >103 | 0.91 | >50 | >50 | >50 |
| RHPA4259.7 | 14.44 | 1.56 | >50 | >50 | >50 |
| TRO.11 | >103 | 0.89 | >50 | >50 | >50 |
| PVO.4 | >103 | 1.87 | >50 | >50 | >50 |
| YU2.DG | 91.49 | 2.77 | >50 | >50 | >50 | h
Patient 12, Clone RU16

|  | 12A12 | 12A21 | 12A4 | 12A37 | 12A22 | 12A16 |
|---|---|---|---|---|---|---|
| MW965.26 | 0.2 | 0.85 | 1.24 | 0.3 | 0.21 | 0.58 |
| BaL.26 | 0.08 | 0.004 | 0.007 | 0.03 | 0.14 | 0.25 |
| DJ263.8 | 0.31 | 0.42 | 1.06 | 0.57 | 1.86 | 0.12 |
| 6535.3 | >50 | >50 | >50 | >50 | >25 | >42 |
| RHPA4259.7 | 0.4 | 0.13 | 0.19 | 0.19 | 0.13 | 0.93 |
| TRO.11 | 0.98 | 0.57 | 1.12 | 3.81 | 1.94 | 2.57 |
| PVO.4 | 3.15 | 2.09 | 2.95 | 1.8 | 1.49 | 8.72 |
| YU2.DG | 0.31 | 0.06 | 0.1 | 0.07 | 0.36 | 1.13 |

Patient 12, Clone RU16

|  | 12A20 | 12A6 | 12A23 | 12A46 | 12A55 |
|---|---|---|---|---|---|
| MW965.26 | 2.2 | 0.52 | >50 | >50 | 4.49 |
| BaL.26 | 0.23 | 0.47 | 3.47 | 0.08 | >50 |
| DJ263.8 | ND | 0.08 | 30.81 | >50 | >50 |
| 6535.3 | ND | >24 | >50 | >50 | >50 |
| RHPA4259.7 | 0.49 | 1.02 | 1.69 | >50 | >50 |
| TRO.11 | 2.41 | 5.15 | 10.11 | >50 | >50 |
| PVO.4 | 11.2 | 17.34 | 7.81 | 797 | 4.3 |
| YU2.DG | 0.67 | 1.2 | 0.19 | 0.25 | 0.29 |

B12 and NIH45 Clone

|  | B12 | VRC01 | NIH45-46 |
|---|---|---|---|
| MW965.26 | 0.2 | <0.08 | 0.04 |
| BaL.26 | 0.2 | 0.1 | <0.04 |
| DJ263.8 | >50 | 0.08 | <0.04 |
| 6535.3 | 1.4 | 0.539 | 0.14 |
| RHPA4259.7 | 0.1 | 0.06 | <0.05 |
| TRO.11 | >50 | 0.2 | 1.9 |
| PVO.4 | >50 | 0.2 | 0.17 |
| YU2.DG | 2.2 | 0.12 | <0.05 |

TABLE 5 a
In vitro Tzm-bl neutralization assay, extended panel IC50 values

|  | B12 | VRC01 | NIH45-46 | 3BNC60 | 3BNC62 | 3BNC117 | 3BNC55 |
|---|---|---|---|---|---|---|---|
| Q842.d12 | >50 | 0.03 | 0.008 | 0.01 | <0.01 | <0.01 | 0.011 |
| 3415.v1.c1 | 2.5 | 0.06 | 0.017 | 0.1 | 0.17 | 0.17 | 0.11 |
| 3365.v2.c20 | >50 | 0.03 | 0.029 | 0.02 | 0.03 | 0.03 | 0.221 |
| H086.8* | >50 | >50 | >30 | >15 | >15 | >15 | >30 |
| ZM53M.PB12 | >50 | 1.3 | 0.187 | 0.22 | 0.3 | 0.21 | 12.549 |
| Du172.17* | 0.3 | >50 | >30 | 3.81 | 1.72 | 1.19 | 3.518 |
| ZM109F.PB4 | >50 | 0.128 | 0.059 | 0.22 | 0.14 | 0.14 | 0.083 |
| 3016.v5.c45 | 1.1 | 0.16 | >30 | 1.4 | 0.42 | 1.38 | >30 |
| 231965.c1 | 0.07 | 0.34 | 0.021 | 0.07 | 0.05 | 0.05 | 0.505 |
| X1254_c3 | >50 | 0.07 | 0.027 | 0.09 | 0.08 | 0.08 | 0.138 |
| 250-4* | >50 | >50 | >30 | >15 | >15 | >15 | 0.236 |
| 251-18 | >50 | 2.5 | 1.445 | 0.35 | 0.32 | 0.26 | >30 |
| 278-50* | >50 | >50 | >30 | >15 | >15 | >15 | >30 |
| 620345.c1* | >50 | >50 | >30 | >15 | >15 | >15 | >30 |
| R1166.c1 | >50 | 1.7 | 0.445 | 0.14 | 0.32 | 0.17 | 0.298 |

TABLE 5-continued

In vitro Tzm-bl neutralization assay, extended panel IC50 values

| | 1NC9 | 1B2530 | 8ANC131 | 8ANC134 | 8ANC195 | 12A12 | 12A21 |
|---|---|---|---|---|---|---|---|
| Q842.d12 | 0.02 | 0.249 | 0.053 | 0.061 | >30 | 0.014 | 0.015 |
| 3415.v1.c1 | 0.266 | 0.065 | 0.299 | 0.323 | 2.404 | 0.121 | 0.82 |
| 3365.v2.c20 | 0.329 | 4.357 | >30 | >30 | >30 | 0.068 | 0.045 |
| H086.8* | >30 | >30 | >50 | >50 | 0.095 | >30 | >30 |
| ZM53M.PB12 | 0.705 | 0.912 | >30 | >30 | 9.626 | 0.593 | 0.42 |
| Du172.17* | >30 | >30 | >30 | >30 | 10.797 | 0.196 | 0.126 |
| ZM109F.PB4 | 0.023 | >30 | >30 | >30 | >30 | 0.148 | 2.104 |
| 3016.v5.c45 | >30 | >30 | >30 | >30 | 0.195 | 1.163 | 0.097 |
| 231965.c1 | 0.393 | 0.168 | 6.346 | >30 | 0.514 | 2.217 | >30 |
| X1254_c3 | >30 | >30 | >30 | >30 | 1.524 | 1.032 | 26.793 |
| 250-4* | >30 | >30 | >50 | >50 | >50 | >30 | >30 |
| 251-18 | 1.234 | 9.847 | 0.968 | 1.56 | 0.284 | 2.622 | 1.713 |
| 278-50* | >30 | >30 | >50 | >50 | >50 | >30 | >30 |
| 620345.c1* | >30 | >30 | >50 | >50 | >50 | >30 | >30 |
| R1166.c1 | 0.651 | 0.119 | >30 | >30 | 0.986 | 0.342 | 0.292 | b
In vitro Tzm-bl neutralization assay, extended panel IC80 values

| | B12 | VRC01 | 45-46 | 3BNC60 | 3BNC62 | 3BNC117 | 3BNC55 |
|---|---|---|---|---|---|---|---|
| Q842.d12 | >50 | 0.096 | 0.026 | 0.03 | 0.03 | 0.01 | 0.062 |
| 3415.v1.c1 | 14.1 | 0.15 | 0.069 | 0.37 | 0.4 | 0.47 | 0.388 |
| 3365.v2.c20 | >50 | 0.17 | 0.114 | 0.08 | 0.09 | 0.1 | 2.341 |
| H086.8* | >50 | >50 | >30 | >15 | >15 | >15 | >30 |
| ZM53M.PB12 | >50 | 4 | 0.652 | 0.76 | 1.1 | 0.85 | >30 |
| Du172.17* | 2.6 | >50 | >30 | >15 | 12.18 | 8.9 | >30 |
| ZM109F.PB4 | >50 | 0.754 | 0.22 | 1.23 | 0.78 | 0.88 | 0.396 |
| 3016.v5.c45 | 4 | 0.42 | >30 | 7.38 | 2.35 | >15 | >30 |
| 231965.c1 | 0.16 | 1.2 | 0.1 | 0.25 | 0.22 | 0.22 | 2.78 |
| X1254_c3 | >50 | 0.19 | 0.078 | 0.29 | 0.27 | 0.27 | 0.571 |
| 250-4* | >50 | >50 | >30 | >15 | >15 | >15 | 1.922 |
| 251-18 | >50 | 11.2 | 5.255 | 0.96 | 1 | 0.82 | >30 |
| 278-50* | >50 | >50 | >30 | >15 | >15 | >15 | >30 |
| 620345.c1* | >50 | >50 | >30 | >15 | >15 | >15 | >30 |
| R1166.c1 | >50 | 4.6 | 1.679 | 0.51 | 0.89 | 0.64 | 2.351 |

In vitro Tzm-bl neutralization assay, extended panel IC80 values

| | 1NC9 | 1B2530 | 8ANC131 | 8ANC134 | 8ANC195 | 12A12 | 12A21 |
|---|---|---|---|---|---|---|---|
| Q842.d12 | 0.133 | 2.191 | 0.179 | 0.205 | >30 | 0.06 | 0.066 |
| 3415.v1.c1 | 1.002 | 0.35 | 1.555 | 2.643 | 17.743 | 0.418 | 0.296 |
| 3365.v2.c20 | 2.163 | >30 | >30 | >30 | >30 | 0.192 | 0.166 |
| H086.8* | >30 | >30 | >50 | >50 | 5.328 | >30 | >30 |
| ZM53M.PB12 | 2.771 | 4.022 | >30 | >30 | >30 | 2.069 | 1.458 |
| Du172.17* | >30 | >30 | >30 | >30 | >30 | 0.992 | 0.037 |
| ZM109F.PB4 | 0.146 | >30 | >30 | >30 | >30 | 0.698 | 13.686 |
| 3016.v5.c45 | >30 | >30 | >30 | >30 | 0.872 | 11.864 | 0.358 |
| 231965.c1 | 2.276 | 0.963 | >30 | >30 | 2.355 | 15.102 | >30 |
| X1254_c3 | >30 | >30 | >30 | >30 | 6.949 | 5.777 | >30 |
| 250-4* | >30 | >30 | >50 | >50 | >50 | >30 | >30 |
| 251-18 | 6.291 | >30 | 5.55 | 6.281 | 1.511 | 9.39 | 6.063 |
| 278-50* | >30 | >30 | >50 | >50 | >50 | >30 | >30 |
| 620345.c1* | >30 | >30 | >50 | >50 | >50 | >30 | >30 |
| R1166.c1 | 2.669 | 0.684 | >30 | >30 | 4.83 | 1.85 | 2.137 |

TABLE 6

Affinity of IgG Antibodies to YU-2 gp140 and 2CC-core Ligands Measured by Surface Plasmon Resonance

| | gp140 | | | 2CC-Core | | |
|---|---|---|---|---|---|---|
| | $k_a$ (M$^{-1}$s$^{-1}$) | $k_d$ (s$^{-1}$) | $K_D$ (M) | ka (M$^{-1}$s$^{-1}$) | $k_d$ (s$^{-1}$) | $K_D$ (M) |
| 12A12 | 4.59E+04 | 1.44E−05 | 3.15E−10 | 6.33E+04 | 1.70E−06 | 2.69E−11 |
| 12A21 | 9.18E+04 | 3.44E−07 | 3.75E12 | 1.82E+05 | 3.30E−04 | 1.81E−09 |
| 12AGL | / | / | / | / | / | / |
| 3BNC60 | 2.73E+04 | 1.86E−04 | 6.81E−09 | 3.02E+04 | 1.64E−03 | 5.45E−08 |
| 3BNC117 | 3.04E+04 | 1.99E−04 | 6.54E−09 | 1.49E−03 | 4.05E+04 | 3.68E−08 |
| 3BNC55 | 1.31E+04 | 7.55E−04 | 5.78E−08 | 8.15E−04 | 3.16E+04 | 2.57E−08 |
| 3BNC66 | 1.60E+04 | 1.41E−03 | 8.81E−08 | 3.96E+04 | 1.33E−03 | 3.36E−08 |
| 3BNC156 | 1.13E+04 | 1.98E−03 | 1.75E−07 | 1.88E+04 | 1.53E−03 | 8.12E−08 |

TABLE 6-continued

Affinity of IgG Antibodies to YU-2 gp140 and 2CC-core Ligands Measured by Surface Plasmon Resonance

| | gp140 | | | 2CC-Core | | |
|---|---|---|---|---|---|---|
| | $k_a$ (M$^{-1}$s$^{-1}$) | $k_d$ (s$^{-1}$) | $K_D$ (M) | ka (M$^{-1}$s$^{-1}$) | $k_d$ (s$^{-1}$) | $K_D$ (M) |
| 3BNC108 | / | / | / | / | / | / |
| 3BNC60GL | / | / | / | / | / | / |
| 8ANC131 | 6.59E+04 | 1.09E−03 | 1.65E−08 | 4.88E+04 | 3.23E−03 | 6.61E−08 |
| 8ANC134 | 1.55E+04 | 1.74E−03 | 1.13E−07 | 2.08E+04 | 9.57E−04 | 4.61E−08 |
| 8AGL | / | / | / | / | / | / |
| 8ANC195 | 4.88E+04 | 1.67E−03 | 3.43E−08 | 2.41E+04 | 1.32E−03 | 5.47E−08 |
| 1NC9 | 4.83E+04 | 5.81E−04 | 1.20E−08 | 5.11E+04 | 2.36E−04 | 4.61E−09 |
| 1B2530 | 4.74E+04 | 1.62E−03 | 3.42E−08 | 6.83E+04 | 4.02E−04 | 5.90E−09 |
| 1GL | / | / | / | / | / | / |
| 4546 | 4.26E+04 | 2.87E−04 | 6.75E−09 | 1.12E+05 | 4.94E−04 | 4.40E−09 |
| VRC01 | 1.83E+04 | 8.08E−06 | 4.41E−10 | 2.84E+04 | 3.25E−05 | 1.15E−09 |

TABLE 7

| | All Nucleotides | Consensus Nucleotides | Non Consensus Nucleotides |
|---|---|---|---|
| a Replacement/Silent mutation ratios for heavy chain sequences of 10 selected antibodies | | | |
| 3BNC117HC | 1.8 | 1.0 | 3.5 |
| 3BNC60HC | 2.0 | 1.1 | 4.4 |
| 12A12HC | 2.8 | 1.7 | 6.3 |
| 12A21HC | 2.6 | 1.5 | 4.8 |
| NIH4546HC | 1.7 | 0.9 | 5.5 |
| VRC01HC | 2.2 | 1.1 | 22.0 |
| 8ANC131HC | 2.7 | 1.3 | 8.0 |
| 8ANC134HC | 2.2 | 1.5 | 3.7 |
| 1B2530HC | 2.0 | 0.9 | 11.0 |
| 1NC9HC | 1.9 | 0.7 | 12.0 |
| b Replacement/Silent mutation ratios for light chain sequences of 10 selected antibodies | | | |
| 3BNC117KC | 1.7 | 0.8 | 2.8 |
| 3BNC60KC | 1.7 | 0.7 | 4.0 |
| 12A12KC | 1.7 | 0.6 | 4.0 |
| 12A21KC | 2.5 | 1.4 | 4.3 |
| NIH4546KC | 1.7 | 0.9 | 3.0 |
| VRC01KC | 1.8 | 0.8 | 4.0 |
| 8ANC131KC | 1.5 | 0.5 | 4.2 |
| 8ANC134KC | 1.5 | 0.5 | 4.2 |
| 1B2530LC | 1.9 | 2.0 | 1.8 |
| 1NC9LC | 1.2 | 0.9 | 1.8 |

TABLE 8

Crystallization data collection and refinement statistics

| Crystal | 3BN60 Fab |
|---|---|
| Data collection* | |
| Wavelength (Å) | 0.9537 |
| Space group | P21 |
| Unit Cell dimensions | |
| a (Å) | 63.6 |
| b (Å) | 155.7 |
| c (Å) | 74.8 |
| α, β, γ (Y) | 90.0, 110.4, 90.0 |
| Resolution, (Å) | 39.172.65 |
| $R_{mrgd}$-F (%)§ | 8.3 (55.5) |
| $R_{meas}$ (%)§ | 7.7 (53.4) |
| I/σI | 15.7 (2.5) |
| Completeness (%) | 96.0 (68.1) |
| Multiplicity | 5.0 (3.6) |
| Reflections | 192709 |
| Unique reflections | 38111 |
| Refinement | |
| Resolution (Å) | 39.172.65 |
| No. reflections | 37086 |
| $R_{work}/R_{free}$ (%)† | 20.7/25.7 |
| RMSD Bond lengths (Å) | 0.01 |
| RMSD Bond angles (Y) | 1.3 |
| Average B-factor Å$^2$ | 64.9 |
| Ramachandran analysis | |
| Favored (%) | 91.9 |
| Allowed (%) | 7.6 |
| Outlier (%) | 0.5 |

SEQUENCE LISTING (1138 sequences)

SEQ ID NO: 1 - protein, 123 aa, Homo sapiens
  MOD_RES (2)..(3): Any naturally occurring amino acid or not present
  MOD_RES (5)..(5): Any naturally occurring amino acid or not present
  MOD_RES (10)..(10): Any naturally occurring amino acid or not present
  MOD_RES (16)..(16): Any naturally occurring amino acid or not present
  MOD_RES (19)..(19): Any naturally occurring amino acid or not present
  MOD_RES (23)..(23): Any naturally occurring amino acid or not present
  MOD_RES (28)..(29): Any naturally occurring amino acid or not present
  MOD_RES (31)..(32): Any naturally occurring amino acid or not present
  MOD_RES (34)..(34): Any naturally occurring amino acid or not present
  MOD_RES (38)..(38): Any naturally occurring amino acid or not present
  MOD_RES (44)..(44): Any naturally occurring amino acid or not present
  MOD_RES (46)..(47): Any naturally occurring amino acid or not present
  MOD_RES (51)..(51): Any naturally occurring amino acid or not present
  MOD_RES (53)..(53): Any naturally occurring amino acid or not present
  MOD_RES (56)..(56): Any naturally occurring amino acid or not present
  MOD_RES (58)..(61): Any naturally occurring amino acid or not present
  MOD_RES (63)..(64): Any naturally occurring amino acid or not present
  MOD_RES (75)..(80): Any naturally occurring amino acid or not present
  MOD_RES (82)..(84): Any naturally occurring amino acid or not present
  MOD_RES (89)..(89): Any naturally occurring amino acid or not present
  MOD_RES (93)..(93): Any naturally occurring amino acid or not present
  MOD_RES (104)..(121): Any naturally occurring amino acid or not present
  MOD_RES (123)..(123): Any naturally occurring amino acid or not present
QXXLXQSGGXVKKPGXSVXVSCXASGYXXFXXYXIHWXRQAPGXGXXWVGXIXPRXGXXXXAXXFQGRLSLTRDXXXXXXTXXXFMDLXGLRXDDTAVYFCARXXXXXXXXXXXXXXXXXXDX

SEQ ID NO: 2 - protein, 101 aa, Homo sapiens
  MOD_RES (3)..(3): Any naturally occurring amino acid or not present
  MOD_RES (9)..(9): Any naturally occurring amino acid or not present
  MOD_RES (13)..(13): Any naturally occurring amino acid or not present
  MOD_RES (15)..(15): Any naturally occurring amino acid or not present
  MOD_RES (18)..(19): Any naturally occurring amino acid or not present
  MOD_RES (24)..(26): Any naturally occurring amino acid or not present
  MOD_RES (28)..(34): Any naturally occurring amino acid or not present
  MOD_RES (36)..(36): Any naturally occurring amino acid or not present
  MOD_RES (42)..(42): Any naturally occurring amino acid or not present
  MOD_RES (44)..(44): Any naturally occurring amino acid or not present
  MOD_RES (51)..(53): Any naturally occurring amino acid or not present
  MOD_RES (55)..(58): Any naturally occurring amino acid or not present
  MOD_RES (62)..(62): Any naturally occurring amino acid or not present
  MOD_RES (67)..(69): Any naturally occurring amino acid or not present
  MOD_RES (71)..(72): Any naturally occurring amino acid or not present
  MOD_RES (74)..(74): Any naturally occurring amino acid or not present
  MOD_RES (76)..(76): Any naturally occurring amino acid or not present
  MOD_RES (79)..(79): Any naturally occurring amino acid or not present
  MOD_RES (81)..(82): Any naturally occurring amino acid or not present
  MOD_RES (85)..(85): Any naturally occurring amino acid or not present
  MOD_RES (87)..(87): Any naturally occurring amino acid or not present
  MOD_RES (91)..(92): Any naturally occurring amino acid or not present
  MOD_RES (95)..(101): Any naturally occurring amino acid or not present
EIXLTQSPXSLSXSXGEXXTISCXXXQXXXXXXXLXWYQQRXGXAPRLLIXXXSXXXXGVPXRFSGXXXGXXYXLXISXLXXDDXAXYFCXXYEXXXXXXX

SEQ ID NO: 3 - protein, 7 aa, Homo sapiens
ASWDFDF

SEQ ID NO: 4 - protein, 5 aa, Homo sapiens
TARDY

SEQ ID NO: 5 - protein, 129 aa, Homo sapiens
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYCARDGLGEVAPDYRYGIDVWGQGSTVIVTAASTKG

SEQ ID NO: 6 - protein, 129 aa, Homo sapiens
QGLLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 7 - protein, 129 aa, Homo sapiens
FQGHLVQSGGGVKKPGTSVTLSCLASEYTFTEFTIHWIRQAPGQGPLWLGLIKRSGRLMTSYRFQDRLSLRRDRSTGTVFMELRSLRTDDTAVYYCARDGLGELAPAYHYGIDAWGQGTTVIVTSASTS

SEQ ID NO: 8 - protein, 127 aa, Homo sapiens
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSAST

SEQ ID NO: 9 - protein, 128 aa, Homo sapiens
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 10 - protein, 127 aa, Homo sapiens
  MOD_RES (10)..(10): Any naturally occurring amino acid or not present
GHLVQSGGGXKKPGTSVTISCLASEYTFTEFTIHRIRQAPGQGPLWLGLIKGSGRLMTSYGFQDRLSLRRDRSTGTVFMELRSLRTDDTAVYYCARDGLGELAPAYHYGIDVWGQGTTVIVTSASTS

SEQ ID NO: 11 - protein, 132 aa, Homo sapiens
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGTTVIVTSASTS

SEQ ID NO: 12 - protein, 129 aa, Homo sapiens
FQGQLVQSGGGVKKPGSSVTISCLASEYTFTEFTIHWIRQAPGQGPLWLGLIKRSGRLMTSYGFQDRLSVRRDRSTGTVFMELRSLRTDDTAVYYCARDGLGELAPAYHYGIDVWGQGTTVIVTSASTS

SEQ ID NO: 13 - protein, 128 aa, Homo sapiens
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 14 - protein, 130 aa, Homo sapiens
  MOD_RES (9)..(9): Any naturally occurring amino acid or not present
  MOD_RES (31)..(31): Any naturally occurring amino acid or not present
QGHLVQSGXEVKKPGSSVKVSCKASGGTFSXYAIGWVRQAPGQGLEWMGGIIPILGTTNYAQRFQGGVTITADESTNTAYMDVSSLRSDDTAVYYCAKAPYRPRGSGNYYYAMDVWGQGTTVIVSSASTS

SEQ ID NO: 15 - protein, 129 aa, Homo sapiens
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 16 - protein, 129 aa, Homo sapiens
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 17 - protein, 129 aa, Homo sapiens
QGHLVQSGGGVKKLGTSVTISCLVSEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 18 - protein, 129 aa, Homo sapiens
QGQLVQSGGGLKKPGTSVTISCLASEYTFNEFVIHWIRQAPGQGPLWLGLIKRSGRLMTAYNFQDRLRLRRDRSTGTVFMELRGLRPDDTAVYYCARDGLGEVAPDYRYGIDVWGQGSTVIVTAASTKG

SEQ ID NO: 19 - protein, 129 aa, Homo sapiens
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSTVIVTSASTKG

SEQ ID NO: 20 - protein, 129 aa, Homo sapiens
QGQLVQSGGGVKKPGASVTISCLASEYTFNEFVIHWIRQAPGQGPLWLGLIKRSGRLMTAYKFQDRLSLRRDRSTGTVFMELRGLRPEDTAVYYCARDGLGEVAPDYRYGIDVWGQGSTVIVSAASTKG

SEQ ID NO: 21 - protein, 129 aa, Homo sapiens; identical to SEQ ID NO: 15

SEQ ID NO: 22 - protein, 132 aa, Homo sapiens
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGSTVIVTSASTS

SEQ ID NO: 23 - protein, 129 aa, Homo sapiens
QGQLVQSGGGVKKPGTSVTISCLASEYTFTEFTIHWIRQAPGQGPLWLGLIKRSGRLMTAYRFQDRLSLRRDRSTGTVFMELRNLRMDDTAVYYCARDGLGELAPAYQYGIDVWGQGTTVIVSSASTKG

SEQ ID NO: 24 - protein, 129 aa, Homo sapiens; identical to SEQ ID NO: 15

SEQ ID NO: 25 - protein, 129 aa, Homo sapiens
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 26 - protein, 129 aa, Homo sapiens
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSKVIVTPASTKG

SEQ ID NO: 27 - protein, 129 aa, Homo sapiens
QGQLVQSGGGVKKLGTSVTIPCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 28 - protein, 129 aa, Homo sapiens
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 29 - protein, 129 aa, Homo sapiens; identical to SEQ ID NO: 15

SEQ ID NO: 30 - protein, 129 aa, Homo sapiens; identical to SEQ ID NO: 15

SEQ ID NO: 31 - protein, 129 aa, Homo sapiens
QGQLVQSGGGVKKTGTSVTISCLASEYTFTEFTIHWIRQAPGQGPLWLGLIKRSGRLMTANRFQDRLSLRRDRSTGTVFMELRSLRIDDTAVYYCARDGLGELAPAYHYGIDVWGQGTTIIVTSASTKG

SEQ ID NO: 32 - protein, 129 aa, Homo sapiens; identical to SEQ ID NO: 31

SEQ ID NO: 33 - protein, 129 aa, Homo sapiens; identical to SEQ ID NO: 23

SEQ ID NO: 34 - protein, 129 aa, Homo sapiens
QGQLVQSGGGGKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 35 - protein, 129 aa, Homo sapiens
QGQLVQSGGGVKKPGTSVTISCLASEYTFNEFVIHWIRQAPGQGPLWLGLIKRSGRLMTSYKFQDRLNLRRDRSTGTVFMELRGLRPDDTAVYYCARDGLGEVAPDYRYGIDVWGQGSTVIVTAASTKG

SEQ ID NO: 36 - protein, 131 aa, Homo sapiens
QVQLQQWGSGLLKPSETLSLTCAVYGGSFRSYYWNWIRQSPGKGLEWIGEVSHSGSTNYNPALKSRVTISVDTSKNQFSLKVKSVTAADTALYYCSRGRGKRCSGAYCFAGYFDSWGQGGLVVVSSASTKG

SEQ ID NO: 37 - protein, 132 aa, Homo sapiens
EVQLVESGGGVVEPGESLRLSCAASGFTFRSYDMFWVRQATGKSLEWVSAIGIAGDTYYSGSVKGRFTISRENARTSLYLQLSGLRVEDSAVYFCVRGSPPRIAATEYNYYYGLDVWGQGTTVSVFSASTKG

SEQ ID NO: 38 - protein, 138 aa, Homo sapiens
VVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 39 - protein, 138 aa, Homo sapiens
QVQLVQSGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 40 - protein, 125 aa, Homo sapiens
EVQLVESGGGLVKPGGSLRLSCAASGFSFSEHYMSWIRLAPGKGLEWLSYISSSTRTTYSADSVRGRFTISRDTAKQLLFLHMSSLRAEDTAVYYCVRLYGGINGWFDQWGQGTLVSVSSASTKG

SEQ ID NO: 41 - protein, 123 aa, Homo sapiens
QVQLVQSGAEVKKPGSSVKVSCKTSGGSFSNYAFSWVRQAPGEGLEWMGRIIPIFGTAKYTQKLQGRVTITADKFTSTVYMELSSLRSEDTAIYYCASLHQGPIGYTPWHPPPRAPLGQSVCG

SEQ ID NO: 42 - protein, 139 aa, Homo sapiens
QVQLVESGAEVKKPGASVKVSCKASGYTFTSHDINWVRQATGQGLEWMGWMNPNSGDTGYAHKFQGRVTMTRNTPISTAYMELSSLRSEDTAVYYCARGRATSRNTPWAHYYDSSGYYGAGDYWGQGTLVTVSSASTKG

SEQ ID NO: 43 - protein, 133 aa, Homo sapiens
QVQLVESGGGVVQPGRSLRLFCAASGFAFNTYGMHWVRQAPGKGLEWVAVTWHDGSQKYYADSVKGRFTISRDNSKNTLYLQMNSLRAEDTAIYYCASDQGGFDDSSGYFAPGGMDVWGRGTTVIVSSAPTKG

SEQ ID NO: 44 - protein, 121 aa, Homo sapiens
QVQLVESGAELRKPGESLEISCKASGYSFSSHWIGWARQMPGKGLEWMGIIYPGDSNTIYSPSFQGQVTISADKSINTAYLQWSSLKASDTAMYFCASNYHDYFYWGQGTLVTVSSASTKG

SEQ ID NO: 45 - protein, 135 aa, Homo sapiens
EVQLVESGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 46 - protein, 138 aa, Homo sapiens; identical to SEQ ID NO: 39

SEQ ID NO: 47 - protein, 135 aa, Homo sapiens
EVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 48 - protein, 143 aa, Homo sapiens
QVFVQLVQSGGGLVQPGGSVRLSCTASGFLFSTYSMNWVRQAPGKGLEWVSSISTTSNYIYYADSVKGRFTISRSNGQGSLYLQLNSLRVEDTAVYYCARDTKVGAPRQDCYAMDLWGQRDHGHRLLSFHQGPIGLPPGALLQ

SEQ ID NO: 49 - protein, 129 aa, Homo sapiens
QVQLLESGPGLVTPSGTLSLACAVSGASISSSHWWTWVRQSPGKGLEWIGEIDRRGTTNYNPSLRSRVTILLDNSKNQFSLSLRSVTAADTAVYYCTKVYAGLFNERTYGMDVWGHGTTVLVSSASTKG

SEQ ID NO: 50 - protein, 138 aa, Homo sapiens
QVQLVESGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 51 - protein, 132 aa, Homo sapiens
QVQLLQSGAEVKKPGASVKVSCKVSGYTLTELSINWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 52 - protein, 131 aa, Homo sapiens
QVQLVQSGTEVQKPGASVKVSCKTSGYTFSKYYIHWVRQAPGQGLEWVGRINTDSGGTDYAEKFQGRVTMTRDTSITTVYLEMRGLTSDDTAAFYCARGPPHAGGWTIYYYGLDVWGQGTSVIVSSASTKG

SEQ ID NO: 53 - protein, 132 aa, Homo sapiens
QVQLVQSGAEVKKPGASVKVSCKVSGHTLSELSINWVRHVPGKGLEWMGGLDPEDGEAIHEPKFQGRLTMTEDTSTDTAYVELSSLRSEDTAMYYCATADPFKVAQDEGLYVIFDYWGQGTLVTVSSASTKG

SEQ ID NO: 54 - protein, 126 aa, Homo sapiens
EVQLVESGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 55 - protein, 138 aa, Homo sapiens
QVQLVQSGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 56 - protein, 124 aa, Homo sapiens
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCAREGSYYYGMDVWGQGTTVTVSSASTKG

SEQ ID NO: 57 - protein, 130 aa, Homo sapiens
EVQLVQSGGGLVQPGRSLRLSCAASGFTFDDYAMHWVRQAPGKGLEWVSGISWNSGTIGYADSVRGRFTISRDDAKSSLYLQMNSLRTEDTALYYCAKDGWVGSGSSTLRGSDYWGQGTLVTVSSASTKG

SEQ ID NO: 58 - protein, 157 aa, Homo sapiens
QIHLVQSGTDVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSRGQGTLISVSAASTKGPSVFPLAPSSKSTYGLAHVL

SEQ ID NO: 59 - protein, 138 aa, Homo sapiens; identical to SEQ ID NO: 39

SEQ ID NO: 60 - protein, 125 aa, Homo sapiens
QLQLQESGPGLVKPWETLVLTCSVSGGSISSGDYYWGWIRQSPGKGPEWIGNIFYSSGNTYYNTSLKSRVTISVDVSKNRFSLKLTSMTAADTAVYYCGRLSNKGWFDPWGQGTLVSVSSASTKG

SEQ ID NO: 61 - protein, 127 aa, Homo sapiens
QVQLLESGGGLVQRGGSLRLSCTASGFVFNNYWMTWVRQAPGNGLEWVANIDQDGSEKHYLDSVKGRFTISRDNAKNSLYLQMNSLRAEDTAIYYCARVRFKVTAWHRFDSWGQGDLVTVSSTSTKG

SEQ ID NO: 62 - protein, 132 aa, Homo sapiens
LVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 63 - protein, 126 aa, Homo sapiens
QVQLVESGGGLGQPGGSLRLSCAASGFTFRNYAMSWVRQAAGKGLEWVSGVSGGGDTTYYGDSVKGRFTISRDNSKNTLYLQMNNLRAEDTAVYYCAKDKGVWGSSDFDYWGQGTLVTVSSASTKG

SEQ ID NO: 64 - protein, 132 aa, Homo sapiens
QVHLVQSGAEVKKPGASVRVSCKASGYTFTTYGISWVRQAPGQGLEWMGWISAHSGDTNYAQKLQARVTMTTDTSTNTAYMELRSLTSDDTAVYYCARDRPRHYYDRGGYYSPFDYWGQGTLVTVSSASTKG

SEQ ID NO: 65 - protein, 139 aa, Homo sapiens
QVQLVESGAEVKKPGSSVKVSCKASGGTFNIFAFSWVRQAPGQGLEWMGGIIPIFASPNYAQRFQGRVTITADESTSTVHMELSSLRSEDTAIYYCAKDAHMHIEEPRDYDYIWGTSPYYFDYWGQGTLVTVSSASTKG

SEQ ID NO: 66 - protein, 132 aa, Homo sapiens
QVQLVQSGAEVKKPGASVKVSCKVSGYTLTELSIHWVRQAPGKGLEWMGGFDSEDGEAFYKQNFQGRVTMTEDTSTDTAYMELRRLRSEDTAVYYCATADRFKVAQDEGLFVIFDYWGQGTLVTVSSASTKG

SEQ ID NO: 67 - protein, 132 aa, Homo sapiens
QVQLLQSGGEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 68 - protein, 135 aa, Homo sapiens
EVQLVESGGGLVQPGGSLRLSCAASGFTFSSYSMNWVRQAPGKGLEWVSYISGSSYTIYYADSVRGRFTISRDNAKNSLYLQMNSLRDEDTAVYFCARATPPNPLNLYNYDSSGSSFDYWGQGTLVTVSSASTKG

SEQ ID NO: 69 - protein, 138 aa, Homo sapiens
QVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 70 - protein, 138 aa, Homo sapiens
QVQLVESGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 71 - protein, 124 aa, Homo sapiens
QVQLVQSGAEIKKPGESLKISCKASGYTFNDYWIGWVRQMPGKGLEWMGIFYPDDSDSNYSPSFQGRVTISADKSITTAYLQWSTLKASDSAMYFCARLLGDSGAFDIWGQGTMVIVSSASTKG

SEQ ID NO: 72 - protein, 138 aa, Homo sapiens
EVQLVESGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 73 - protein, 135 aa, Homo sapiens
QVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 74 - protein, 138 aa, Homo sapiens
QVQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 75 - protein, 126 aa, Homo sapiens
QVQLVQSGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 76 - protein, 133 aa, Homo sapiens
EVQLVQSGGGLVKPGGSLRLSCAASGFTFKNAWMSWVRQAPGKGLEWVGHIKSKTDGGTIDYAAPVKGRFTISRDDSKNTLYLQMNSLKIEDTAVYYCTTDIGSGRGWDFHYYDSNDWGQGTLVTVSSASTKG

SEQ ID NO: 77 - protein, 131 aa, Homo sapiens
EVQLVQSGGGVVQPGRSLRLSCVVSGFTFSSFTFHWVRQAPGKGLEWVAGMSFHATYIYYADSVKGRFTISRDDSQDTLYLEMDSLRSEDTAIYYCARDPGIHDYGDYAPGAFDYWGQGSPVTVSSASTKG

SEQ ID NO: 78 - protein, 132 aa, Homo sapiens
LVQLVQSGAEVKKPGASVKVSCKVSGHTLSELSINWVRHVPGKGLEWMGGLDPEDGEAIHEPKFQGRLTMTEDTSTDTAYSTLSVWAPVAAAMYYCATADPFKVAQDEGLYVIFDYWGQGTLVTVSSASTKG

SEQ ID NO: 79 - protein, 125 aa, Homo sapiens
EVQLVESGAEVKKPGSSVKVSCKASGGTFSSYSISWVRQAPGQGLEWMGGIIPIFATTHYGQKFQGRIKITADKSTSTAYMELSRLRSEDTAVYYCARDREFYFYGMDVWGQGTTVTVSSASTKG

SEQ ID NO: 80 - protein, 131 aa, Homo sapiens
QVQLQQWGAGLLKPSETLSLTCAVYAGSFSGYYWTWIRQPPGKGLEWIGEVNHGGSTNYNPSLKSRVTLSVDTSKNQFSLKLTSVTAADTAVYYCARVSRYDFWSGNYGSYGLDVWGQGTTVTVSSASTKG

SEQ ID NO: 81 - protein, 138 aa, Homo sapiens
VVQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 82 - protein, 154 aa, Homo sapiens
LVQLVQSGAEVKKPGASVKVSCKVSGYSLTELSIHWVRQAPGKGLEWMGGFDSEDGEAIYKQNFQGRVTMTEDTSTDTAYMELSRLRSEDTAVYYCATADPFKVAQDEGLFVIFDYWGQGTTGHRLLSLHQGPHRLYSLGTLLSRAPIVQTHMA

SEQ ID NO: 83 - protein, 135 aa, Homo sapiens; identical to SEQ ID NO: 73

SEQ ID NO: 84 - protein, 135 aa, Homo sapiens
QVQLVQSGAEVKKPGSSVKVSCKASGGTFSTYAFSWVRQAPIEGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 85 - protein, 132 aa, Homo sapiens
QVQLVQWGAGLLKPLETLSLTCAVYGGSFNGYFWSWIRQTPGKGLEWIGEINHGGSANFNPSLKSRVTMSVDTSKNQFSLKLASVTAADTAIYYCARGRITMVRGDPQRGGVRMDVWGQGTSVTVSSASTKG

SEQ ID NO: 86 - protein, 132 aa, Homo sapiens
QVQLMQSGAEVKRPGASVKVSCKAFRHSLNNLGISWIRRAPGRGLEWLGWINVYEGNTKYGRRFQGRVTMTTDRSTNTVSMELRSLTSDDTAVYYCARDNHFWSGSSRYYYFGMDVWGQGTTVIVSSASTKG

SEQ ID NO: 87 - protein, 125 aa, Homo sapiens
QVQLVQSGGGLVQPGESLRLSCTASGFTFSSYNMNWVRQAPGKGLEWISYISDKSKNKYYADSVRGRFTISRDNAQNSLFLQMSSLRDEDTAVYYCTREGPQRSFYFDYWGQGIQVTVSSASTKG

SEQ ID NO: 88 - protein, 126 aa, Homo sapiens
QVQLQESGPGLVKPSETLSLTCTVSGGSISNHYWSWIRQPPGKGLEWIGYIYHSGNINYKSSLKSRATISIDTSNNQFSLKLSSVIAADTAVYYCARNFGPGSPNYGMDVWGQGTTVTVSSASTKG

SEQ ID NO: 89 - protein, 130 aa, Homo sapiens
VVQLVQSGPGLVKPSQTLSLTCTVSGGSISSGDFYWSWIRQPPGKGLEWIGYIYYSGSTYYNPSLKSRLTISVDTSKNQFSLRLSSVTAADTAVYYCARDLNSRIVGALDAFDIWGQGTMVTVSSASTKG

SEQ ID NO: 90 - protein, 129 aa, Homo sapiens
QVQLVESGGALVQPGGSLRLSCAASGFSFSSYAMSWVRQAPGKGLEWVSAISRSGGSTYYADSVKGRFTISIDNSNNTLYLQMNSLRVEDTAVYYCAKREAFYYGAGGYGMDVWGQGTTVTVSSASTKG

SEQ ID NO: 91 - protein, 130 aa, Homo sapiens
EVQLVESGGGLVKPGGSLRLSCEASGFTFTNAWMNWVRQAPGKGLEWVGRIKSQTHGGTTRYAAPVKGRFTISRDDSKHTLYLQMDRLTTEDTAVYYCTGTITGSTFYYYGMDVWGQGTTVTVSPASTKG

SEQ ID NO: 92 - protein, 132 aa, Homo sapiens
EVQLVESGGGLLQPGGSLRLSCAASGFSFNDFEMNWVRQAPGKGLEWVSYISNDGTMIHYADSVKGRFTISRDNAKKSLFLQMNSLRAEDTAVYYCARLAEVPPAIRGSYYYGMDVWGQGTTVTVASASTKG

SEQ ID NO: 93 - protein, 123 aa, Homo sapiens
QVQLQESGPGLLRPLETLSLTCSVSGGSIRGYFWSWVRQPAGRGLEWIGRIYSSGTTRFNPSLKSRVRLSIDTAKSEVSLNITSVTAADSASYFCAGTSPVHGGLDLWGLGLRVTVSSASTKG

SEQ ID NO: 94 - protein, 135 aa, Homo sapiens
HLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSWGQGTLISVSAASTKG

SEQ ID NO: 95 - protein, 132 aa, Homo sapiens
EVQLVQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 96 - protein, 129 aa, Homo sapiens
QVQLVESGGGLVQPGGSLRLSCAASGFTFSTHWMHWVRQAPGKGLVWVSRIHSDGRSTSYADSVKGRFTISRDNAKNTLYLQMNSLRAEDTAVYYCARGAAVFGVVIIGGMDLWGQGTTVTVSSASTKG

SEQ ID NO: 97 - protein, 127 aa, Homo sapiens
EVQLVESGGGVVQPGGSLRLSCAASGFMFKNYAMHWVRQPPGKGLEWVAVIWYGGRDQNYADSVKGRFTISRDDSDNTLYLQMNSLRAGDTAVYFCARNSQVGRLMPAAGVWGQGTLVTVSSASTKG

SEQ ID NO: 98 - protein, 123 aa, Homo sapiens
EVQLVESGGGLIQRGGSLRLSCVASGFPVSDNHMSWVRQAPGKGLEWVSIIYSDGGTYYADSVKGRFTISRDNSKNTVYLQMNSLRATDTAVYYCARDPGFHYGLDVWGQGTTVTVSSASTKG

SEQ ID NO: 99 - protein, 124 aa, Homo sapiens
VVQLVESGGGLVQPGGSLRLSCAASGFAFRSYWMSWVRQAPGRGLEWVANIKQDGSEKYYADSVKGRFTISRDNTKNSLYLQMNSLRAEDTAVFYCASRGDRYGPIDYWGQGTLVTVSSASTKG

SEQ ID NO: 100 - protein, 125 aa, Homo sapiens
VVQLVESGTEVKKPGSSVKVSCKASGGTFSGSDISWVRQAPGQGLEWMGGIIPMFDIENHAEKFRGRLTITAVKSTGAAYMELSSLRSEDAAVYYCARSSGNYDFAYDIWGQGTRVIVSSASTKG

SEQ ID NO: 101 - protein, 135 aa, Homo sapiens; identical to SEQ ID NO: 47

SEQ ID NO: 102 - protein, 130 aa, Homo sapiens
EVQLVQSGGGLVQPGGSLRLSCAASGLTFRNFAMSWVRQAPGKGLEWVSSISGSGGSTYYADSVKGRFTISRDNSKNTLYLQMNSLRGEDTAVYFCAKGVGYDILTGLGDAFDIWGQGTVVAVSSASTKG

SEQ ID NO: 103 - protein, 137 aa, Homo sapiens
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKG

SEQ ID NO: 104 - protein, 125 aa, Homo sapiens
VVQLVQSGTEVKKPGSSVKVSCKASGGTFSGSDISWVRQAPGQGLEWMGGIIPMFDIEDHAQKFRGRLTITADKSTGAAYMELSSLRSEDAAVYYCARSSGNYDFAFDIWGQGTRLIVSSASTKG

SEQ ID NO: 105 - protein, 132 aa, Homo sapiens
QVQLGESGGGLVEPGGSLRLSCAASGFLFSDYQMSWIRLAPGKGLEWISFISGFGSVYYADSVEGRFTISRDNARNSLYLQMNNLRAEDTAVYYCARAYGTGNWRGLYYYYYGMDVWGHGTTVTVSSASTKG

SEQ ID NO: 106 - protein, 122 aa, Homo sapiens
QLQLVESGGGVVQPGRSLRLSCAASGFTFSTYTMHWVRQAPGKGLEWVAVISYDGTNKYYADSVKGRFTISRDNSKNTLYLQMNSLRGEDTAVYYCARSPSYYFDYWGQGTLVTVSAASTKG

SEQ ID NO: 107 - protein, 128 aa, Homo sapiens
QVQLVQSGAEVKMPGASVKVSCKVSGYSLTELSIHWVRQAPGKRLEWMGGFDPEDDERIYAQKFQDRVTMTEDTSTDTAYMDLNSLRSEDTAVYYCTTGGLYCSSISCIMDVWGQGTTVIVSSASTKG

SEQ ID NO: 108 - protein, 128 aa, Homo sapiens
QVQLVQSGAEVKKPGASVKVSCKVSGYTLTELSIHWVRQAPGKRLEWMGGFDPEDGERIYAQKFQGRVTMTEDTSTDTAYMELNSLRSDDTAVYYCATGGLYCSSISCIMDVWGQGTTVTVSSASTKG

SEQ ID NO: 109 - protein, 153 aa, Homo sapiens
QVQLVQSGAEVKKPGASVKVSCKVSGYTLTELSIHWVRQAPGKGLEWMGGFDSEDGEAIYKQNFQGRVTMTEDTSTDTAYMELSRLRSEDTAVYYCATADRFKVAQDEGLFVIFDYWGQGNPGHRLLSLHQGPIGLPPGTLPPKATSGHAARR

SEQ ID NO: 110 - protein, 129 aa, Homo sapiens
QVQLVESGGGVVQPGRSLRLSCAASGFTFSSYAMHWVRQAPGKGLEWVAVISYDGSNKYYADSVKGRFTISRDDSKSTVYLQINSLRAADTAVYFCAREGGLRFLEWLFWGQGTLVTVSSGESSASTKG

SEQ ID NO: 111 - protein, 126 aa, Homo sapiens
EFQLVQSGGGLVKPGGSLRLSCTGSTFSFSSDDMNWVRQAPGKGLEWVSSMSDSGSHIYYADFVKGRFTISRDNAKKSLYLQMNSLRAEDTAVYYCAQSRPPQRLYGMDVWGQGTTVTVSSASTKG

SEQ ID NO: 112 - protein, 132 aa, Homo sapiens
QVQLVQSGAEVKKPGASVKVSCKVSGYTLTELSIHWVRQAPGKGLEWMGGFDPEDGEASFEPKFQGRLTMTEDTSTDTAYMELSSLRSEDTAVYYCATADPFKVAQDEGLYVIFDYWGQGTLVTVSSASTKG

SEQ ID NO: 113 - protein, 124 aa, Homo sapiens
QVQLVESGGGVVQPGKSLRLSCAASGFTFSTHAMHWVRQAPGKGLDWVAVISHDGDNQYYADAVKGRFTISRDDSRDTVFLQMNSLRTEDTGVYYCAADSSGSNWFDYWGQGILVTVSSASTKG

SEQ ID NO: 114 - protein, 121 aa, Homo sapiens
EPMFQPGQSGGVVVQSGESLHLSCEASGFKFASQMMHWVRHVPGRGLEWVALISWDGSGKLFADSVRGRFTIHRWNDRNSLYLDVKNVRPEDAAIYYCTRNGFDVWGQGILVTVSSASTKG

SEQ ID NO: 115 - protein, 132 aa, Homo sapiens
QVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 116 - protein, 131 aa, Homo sapiens
QVHLQESGPRLVRSSETLSLTCSVPGGSIVNPITNYYWSWIRQSPRKGLQWIGDIYYTGTSSRNPSLDSRVSISMDVSRKQISLTLYSVTAADTAVHYCASQSLSWYRPSGYFESWGQGILVTVSSASTKG

SEQ ID NO: 117 - protein, 128 aa, Homo sapiens
QVQLVQSGAEVKKPGSSMKVSCKSSGGTFSNHAISWVRQAPGKGLEWMGGIIPMSGTTNYLQKFQGRVTITADEFATTAYMELSSLTSEDTAVYYCARARADSHTPIDAFDIWGPGTRVIVSSASTKG

SEQ ID NO: 118 - protein, 125 aa, Homo sapiens
QVQLVQSGTEVKKPGSSVKVSCKASGGTFSDSDIAWVRQAPGQGLEWMGGITPMFDMAKSAQKFRGRLIITADKSTGTAYMELSSLRYEDAAVYFCARSSGNFEFAFEIWGQGTKIIVSLASTKG

SEQ ID NO: 119 - protein, 128 aa, Homo sapiens
QVQLVQSGAEVKKPGASVKVSCKASGYTFTSYDINWVRQATGQGLEWMGWMNPNSGNTGYAQTFQGRVTMTRNTSISTAYMELSSLRSEDTAVYYCARDRWLPQYYYYGMDVWGQGTTVTVSSASTKG

SEQ ID NO: 120 - protein, 134 aa, Homo sapiens
FVQLVESGGGLVQPGGSLRLSCAASGFNFNTYWMNWVRQAPGKGLEWVANMKEDGSEKYYVDSVKGRFTISRDNAKNSLYLQMNSLRAEDTAVYYCARNPESRCIVGRNRGWCRYFDLWGRGSLVTVSPASTKG

SEQ ID NO: 121 - protein, 141 aa, Homo sapiens
LVQLVESGGGVVQPGRSLRLSCAASGFTFSTYAMHWVRQAPGKGLEWVAVISYDGSNKFYADSVKGRFTISRDNSKNTLYLQMNSLRAEDTAVYYCARPKFLPGADIVVVVAATPFDYWGQGNPGHRLLSFHQGPIGLPPG

SEQ ID NO: 122 - protein, 120 aa, Homo sapiens
PMFQPGQSGGVVVQSGESLHLSCEASGFKFASQMMHWVRHVPGRGLEWVALISWDGSGKLFADSVRGRFTIHRWNDRNSLYLDVKNVRPEDAAIYYCTRNGFDVWGQGILVTVSSASTKG

SEQ ID NO: 123 - protein, 132 aa, Homo sapiens; identical to SEQ ID NO: 53

SEQ ID NO: 124 - protein, 138 aa, Homo sapiens; identical to SEQ ID NO: 74

SEQ ID NO: 125 - protein, 126 aa, Homo sapiens
LVQLVESGGGVVQPGKSLRLSCATSGFTFSTYGMHWVRQAPGKGLEWVAVIWYDGSYKYYADSVKGRFTISRDNSKNTLFLQMNSLRAEDTAMYYCGREMAVGGTKALDHWGQGTLVTVSSASTKG

SEQ ID NO: 126 - protein, 118 aa, Homo sapiens
QVQLVQSGAEAKRPGDSVKVSCKASGYTFTEYYIHWVRQTPGQGFEWMGIITPGAGNTTYAQKFQGRITVTRDTSAATVYMELSNLTSEDTAVYFCSRGVSFWGQGTLVTVSSASTKG

SEQ ID NO: 127 - protein, 122 aa, Homo sapiens
QVQMVASGGGLVKPGGSLRLSCEASGFTFSDYYMSWVRQAPGKGLEWISYITSGGNALYYADSVKGRFTISRDNAKNSLYLQMNSLRAEDTAVYYCARDLLHAHDFGRQGTLVTVSSASTKG

SEQ ID NO: 128 - protein, 127 aa, Homo sapiens
QVQLVESGGGVVQPGRSLRLSCATSGFTSKNYGVHWVRQAPGKGLEWVAVIWYDGSNKFYADSVKGRFTISRDRSKNMVYLQMNSLRVEDTAIYYCARDSVAFVLEGPIDYWGQGTLVTVSSASTKG

SEQ ID NO: 129 - protein, 129 aa, Homo sapiens
QVQLVQSGAEVKKPGASVKVSCKASGYTFTDYYIHWVRQAPGQGLEWMGWINPSTGGTNFVQKFLGRVTMTSDTSINTAYMELRRLKNDDAAIYYCATYSTRQFFHYYYVTDVWGQGTTVTVSSASTKG

SEQ ID NO: 130 - protein, 134 aa, Homo sapiens
QVQLVQSGAEVKKPGSSVKVSCRASGGSFGNYAINWVRQAPMQGLEWMGGIIPIFGTTNYAQNFRGRVTINADTFTNTVNMDLSSLRSEDTAVYYCGRSINAAVPGLEGVYYYYGMAVWGQGTTVTVSSASTKG

SEQ ID NO: 131 - protein, 134 aa, Homo sapiens
QVQLHQWGAGLLKPSDTLSLTCGILGVSPPGSLTGYYWTWIRQPPGKGLEWIGEVYHSGSTNYNPSLASRVTISMGTTKTQFSLRLTSVTAADSAVYYCASGKVWGITARPRDAGLDVWGQGTTVTVTSASTKG

SEQ ID NO: 132 - protein, 126 aa, Homo sapiens
EVQVVESGGGLVQPGGSLRLSCVASGFTFSEYWMSWVRQAPGKGLEWVATIKRDGSEESYVDSVKGRFTISRDNAKNSLYLQMNSLRAEDTAVYYCARVRDPNYNLHFDSWGQGTLVTVSSASTKG

SEQ ID NO: 133 - protein, 122 aa, Homo sapiens
QVQLVESGGGLIQPGGSLRLSCEASGFAVGDINYMSWVRQAPGKGLEWVSVLYSGGSSQYADSVKGRFTISRDNSRNTLYLQMDNLRAEDTAVYYCARGLRVYFDLWGQGILVTVSSASTKG

SEQ ID NO: 134 - protein, 135 aa, Homo sapiens; identical to SEQ ID NO: 73

SEQ ID NO: 135 - protein, 125 aa, Homo sapiens
QVQLQESGPGLVKPSETLSLTCTVSGGSISSRSYYWGWIRQPPGKGLEWVGSIYYTGSTYYSPSLKSRVTISVDTSQNQFSLKLNSVTAADTAVYYCARQKGSGTSLLYWGQGTLVTVSSASTKG

SEQ ID NO: 136 - protein, 129 aa, Homo sapiens
QVQLVQSGSELKKPGASVKVSCKASGYTFTSYAINWVRQAPGQGLEWMGWINTNTGNPTYAQGFTGRFVFSLETSVSTAYLQINSLKAEDTAVYYCARDLLESRTYYNDIRDCWGQGTLVTVSSASTKG

SEQ ID NO: 137 - protein, 123 aa, Homo sapiens
QVQLQESGSGLVKPSGTLSLTCAVSNGPISSGNWWSWVRQTPEKGLEWIGEVYHSGSTNHNPSLKSRATILVDKSKNQFSLNLRSVTAADTAVYYCARVRGSWNFDYWGQGILVTVSSASTKG

SEQ ID NO: 138 - protein, 159 aa, Homo sapiens [sequence omitted]

SEQ ID NO: 139 - protein, 138 aa, Homo sapiens; identical to SEQ ID NO: 55

SEQ ID NO: 140 - protein, 135 aa, Homo sapiens; identical to SEQ ID NO: 73

SEQ ID NO: 141 - protein, 127 aa, Homo sapiens
QVHLEESGPGLVKTSQTLSLTCSVSSYSISRSGYFWTWIRQRPGKGLEWIGYIYFNGRTTYNPSLKSRITISRDTSHSQFSLTLNSLSAADTAVYYCGRCQDGLASRPIDFWGQGTLVTVSSASTKG

SEQ ID NO: 142 - protein, 127 aa, Homo sapiens
QVQLVESGGGVVQPGKSLRLSCAISGFLFNNYGGQWVRQAPGKGLEWVAAISYDGNNRYYADSAKGRFLISRDTPKNILYLQIYSLRLDDTAVYYCARDSVSKSYSAPPEFWGQGTVVTVSSASTKG

SEQ ID NO: 143 - protein, 134 aa, Homo sapiens
QLQLQESGPGLVKPSETLSLTCSVSDGSINSNSYYWAWIRQSPGKGLEWIGSVYYFGGTYYSPSLKSRVTMSVDRSKNQFSLNVSSVTAADTAIYYCARHVRPYDRSGYPERPNWFDPWGRGTLVTVSSASTKG

SEQ ID NO: 144 - protein, 125 aa, Homo sapiens
RVQLVQSGAEVKKPGSSVTVSCKASGGSFSSYAISWVRQAPGQGLEWVGGVKVMFGTVHYSQKVQGRVTITADDSTGTSYLELSGLRSADTAVYYCARNAGAYFYPFDIWGQGTLIIVSSASTKG

SEQ ID NO: 145 - protein, 136 aa, Homo sapiens
QVQLVQSGAEVKKPGASVKVSCKASGYTFTRYHIHWVRHAPGQGLEWMGKINPSRASTKYAKKFQDRVTMTRDTSTSTVYMELSSLRGDDTAVYYCGREMGTFTLLGVVIDHYDFYPMDVWGQGTPVTVSSASTKG

SEQ ID NO: 146 - protein, 138 aa, Homo sapiens
QVQLVQSGAEVRKPGSSLKVSCKSSGGTFSRYVVNWVRQAPGQGLEWMGGIIPIFGIAKYAQKFQDRVTMTADESKNTVYLDFSSLRSGDTAVYYCARDRGDTRLLDYGDYEDERYYYGMDVWGQGTTVTVSSASTKG

SEQ ID NO: 147 - protein, 127 aa, Homo sapiens
SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKG

SEQ ID NO: 148 - protein, 127 aa, Homo sapiens
SQQLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSAASTKG

SEQ ID NO: 149 - protein, 127 aa, Homo sapiens
SQQLVQSGTQVKKPGASVRISCQASGYSFTDYVLHWYRQAPGQGLEWMGWIKPVYGARNYARRFQGRINFDRDIYREIAFMDLSGLRSDDTALYFCARDGSGDDTSWYLDPWGQGTLVIVSAASTKG

SEQ ID NO: 150 - protein, 127 aa, Homo sapiens
SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSAASTKG

SEQ ID NO: 151 - protein, 127 aa, Homo sapiens
SQQLVQSGTQVKKPGASVRVSCQASGYTFMNYIIHWWRQAPGQRLEWMGWINPVFGARNYAHRFQGRINFDRDINRETFQMELTGLRSDDTAVYYCARDGSGDARDWHLDPWGQGTLVIVSSASTKG

SEQ ID NO: 152 - protein, 127 aa, Homo sapiens
SQHLVQSGTQVKKPGASVRVSCQASGYTFTNYILHWWRQAPGQGLEWMGLIKPVFGAVNYARQFQGRIQLTRDINREIAFLDLSGLRSDDTAVYYCARDESGDDLKWHLHPWGQGTQVIVSPASTKG

SEQ ID NO: 153 - protein, 127 aa, Homo sapiens
SQQLVQSGTQVKKPGASVRVSCQASGYTFMNYIIHWWRQAPGQRLEWMGWINPVFGARNYAHRFQGRINFDRDINRETFQMDLTGLRSDDTAVYYCARDGSGDARDWHLHPWGQGTLVIVSSASTKG

SEQ ID NO: 154 - protein, 127 aa, Homo sapiens; identical to SEQ ID NO: 147

SEQ ID NO: 155 - protein, 127 aa, Homo sapiens
SQQLVQSGTQVKKTGASVRVSCQASGYDFTKYLIHWWRQAPGQGLEWMGWMKPVYGATNYAHRFQGRISFTRDIYREIAFMDLNGLRSDDTAVYFCARDGGGDDRTWLLDAWGQGTLVIVSSASTKG

SEQ ID NO: 156 - protein, 127 aa, Homo sapiens; identical to SEQ ID NO: 152

SEQ ID NO: 157 - protein, 127 aa, Homo sapiens
SQQLVQSGTQVKKPGASVRISCQASGYTFTDYVLHWWRQAPGQGLEWMGWIKPVYGARNYARRFQGRINFDRDIYREIAFLDLSGLRSDDTARYFCARDGSGDDTSWHLHPWGQGTLVIVSAASTKG

SEQ ID NO: 158 - protein, 127 aa, Homo sapiens; identical to SEQ ID NO: 150

SEQ ID NO: 159 - protein, 127 aa, Homo sapiens; identical to SEQ ID NO: 150

SEQ ID NO: 160 - protein, 127 aa, Homo sapiens; identical to SEQ ID NO: 155

SEQ ID NO: 161 - protein, 126 aa, Homo sapiens
SQQLVQSGAQVKKPGASVRVSCQASGYTFTNHFLHWWRQAPRQGLEWMGWINPVHGGRNYARRFQGRINFGRDVYQETAYMELSGLRNDDTATYFCARGGGDGRNWHLHPWGQGTLVIVSAASTKG

SEQ ID NO: 162 - protein, 127 aa, Homo sapiens; identical to SEQ ID NO: 147

SEQ ID NO: 163 - protein, 127 aa, Homo sapiens
SQQLVQSGAQVKKPGASLRVSCQASGYTFMNYLLHWWRQAPGQGLEWMGWINPVYGAVNYAHRFQGRLTFSRDVYREIAYMDLNGLRSDDTAVYFCARDGSGDDRNWHLDPWGQGTLVIVSSASTKG

SEQ ID NO: 164 - protein, 127 aa, Homo sapiens
SQQLVQSGTQVKKPGASVRVSCQASGYTFTNYILHWWRQAPGRGLEWMGLIKPVYGAVNYARQFQGRIQLTRDIYREIAFLDLSGLRPDDTAVYYCARDESGYDLNWHLDSWGQGTQVIVSPASTKG

SEQ ID NO: 165 - protein, 127 aa, Homo sapiens
SQQLVQSGTQVKKPGASVRVSCQASGYTFTDYVLHWWRQAPGQGLEWMGWIKPVYGARNYAHRFQGRINFDRDVYREIAYMDLSGLRSDDTAVYFCARDGSGDATSWHLHPWGQGTLVIVSSASTKG

SEQ ID NO: 166 - protein, 127 aa, Homo sapiens; identical to SEQ ID NO: 151

SEQ ID NO: 167 - protein, 137 aa, Homo sapiens
QVTLVQSGAEVKKPGASVRISCRASGFTFDDYSDYSFIPTTYLIHWFRQAPGQGLEWMAWINSVNGGRNIARQFQGRVTVARDRSNSIAFLEFSGLRHDDTAVYFCARDRRDDDRAWLLDPWGQGTRVTVSSASTKG

SEQ ID NO: 168 - protein, 130 aa, Homo sapiens
QVRLEQSGAAMRKPGASVTLSCQASGYNFVKYIVHWVRQKPGLGFEWVGMIDPYRGRPWSAHKFQGRLSLSRDTSMEILYMTLTSLTSDDTATYFCARAEAASDSHSRPIMFDHWGQGSRVTVSSASTKG

SEQ ID NO: 169 - protein, 130 aa, Homo sapiens
QVRLEQSGTAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 170 - protein, 133 aa, Homo sapiens
QVRLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 171 - protein, 130 aa, Homo sapiens
QVRLEQSGAAVRKPGASVTLSCQASGYNFVNYIIHWVRQRPGLDFEWVGMIDPYRGRPWSAHKFQGRLSLSRDVSTEILYMTLSSLRSDDTATYFCARAEAESQSHSRPIMFDFWGQGSRVTVSSASTKG

SEQ ID NO: 172 - protein, 133 aa, Homo sapiens
QVRLSQSGAAIKKPGASVTISCETEGYTFINYIIHWVRQPPGRGFEWLGMIDPRNGRPWFGQSVQGRLSLRRDTYTEVVYMTLSGLTSDDAGHYFCARNEPQYHDGNGHSLPGMFDYWGQGTLVAVSSASTKG

SEQ ID NO: 173 - protein, 133 aa, Homo sapiens
QVRLSQSGAAVKKPGASVTIVCETEGYNFIDYIIHWVRQPPGRGFEWLGMIDPRNGRPWSGQKVHGRLSLWRDTSTEKVYMTLTGLTSDDTGLYFCGRNEPQYHDDNGHSLPGMIDYWGQGTMVTVSSASTKG

SEQ ID NO: 174 - protein, 133 aa, Homo sapiens; identical to SEQ ID NO: 170

SEQ ID NO: 175 - protein, 133 aa, Homo sapiens; identical to SEQ ID NO: 170

SEQ ID NO: 176 - protein, 133 aa, Homo sapiens; identical to SEQ ID NO: 170

SEQ ID NO: 177 - protein, 130 aa, Homo sapiens
QVRLEQSGAAVRKPGASVTLSCQASGYNFVRYIIHWVRQRPGLDFEWVGMIDPYRGRPWSAHKFGGRLSLTRDVSTEILYMTLTSLRSDDTATYFCARAEAESQSHSRPIMFDSWGQGSRVTVSSASTKG

SEQ ID NO: 178 - protein, 130 aa, Homo sapiens
QVRLEQSGNAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 179 - protein, 130 aa, Homo sapiens
QVRLEQSGAAMRKPGASVTLSCQASGYNFVKYIIHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 180 - protein, 133 aa, Homo sapiens
QVRLFQSGAAMRKPGASVTISCEASGYNFLNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 181 - protein, 130 aa, Homo sapiens; identical to SEQ ID NO: 179

SEQ ID NO: 182 - protein, 133 aa, Homo sapiens
QVRLSQSGAAIKKPGASVTISCETEGYTFINYIIHWVRQPPGRGFEWLGMIDPRNGRPWFGQSVQGRLSLRRDTYTEVVYMTLSGLTSDDTGLYFCARNEPQYHDGNGHSLPGMFDSWGQGTLVAVSSASTKG

SEQ ID NO: 183 - protein, 133 aa, Homo sapiens
QVQLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 184 - protein, 130 aa, Homo sapiens
QVRLEQSGAAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 185 - protein, 133 aa, Homo sapiens
QVRLFQSGAAMKKPGASVTISCEASGYNFMNYFVHWVRQRPGRGFEWLGMINPRGGRPWSAQSVQGRLTLTRDISTEMFYMRLDGLRSDDTATYFCARNEADYHDGNGHSLRGMFDYWGQGSLITVSSASTKG

SEQ ID NO: 186 - protein, 130 aa, Homo sapiens
QVRLEQSGTAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 187 - protein, 133 aa, Homo sapiens; identical to SEQ ID NO: 170

SEQ ID NO: 188 - protein, 133 aa, Homo sapiens; identical to SEQ ID NO: 170

SEQ ID NO: 189 - protein, 133 aa, Homo sapiens; identical to SEQ ID NO: 182

SEQ ID NO: 190 - protein, 133 aa, Homo sapiens; identical to SEQ ID NO: 170

SEQ ID NO: 191 - protein, 130 aa, Homo sapiens; identical to SEQ ID NO: 179

SEQ ID NO: 192 - protein, 130 aa, Homo sapiens; identical to SEQ ID NO: 179

SEQ ID NO: 193 - protein, 144 aa, Homo sapiens
QVRLEQSGVAMRKPGASVTLSCQASGYNFVKYIIHWVRQKPGLGFEWVGMIDPYRGRPWSAHKFQGRLSLSRDTSMEILYMTLTSLKSDDTATYFCARAEAASDIHSRPIILTGPGEYGLDLEHMDWTWRILCLLAVAPGCHSQ

SEQ ID NO: 194 - protein, 130 aa, Homo sapiens; identical to SEQ ID NO: 184

SEQ ID NO: 195 - protein, 130 aa, Homo sapiens
QVRLEQSGTAVRKPGASVTISCQASGYNFVKFFIHGVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 196 - protein, 129 aa, Homo sapiens
QVRLVQSGPQVKTAGASMRVSCEASGYRFLDYIIVWIRQTHGQHFEYVGMINPRGGTPWPSSKFRDRLTLTRDIYTDTFYLGLNNLGSGDTAIYFCARLEADGDDYSPKMFDYWGQGTRIIVSAASTKG

SEQ ID NO: 197 - protein, 133 aa, Homo sapiens
QVHTFQSGSSMKKSGASVTISCEATGYNIKNYILHWVRQKPGRGFEWVGMIDPINGRPWFGQPFRGRLTLTRDLSTETFYMSLSGLTSDDTATYFCARREADYHDGNGHTLPGMFDFWGPGTLITVSSASTKG

SEQ ID NO: 198 - protein, 129 aa, Homo sapiens
QVSLVQSGPQVKTPGASMRVSCETSGYRFLDYIIVWIRQTHGQHFEYVGMINPRGGTPWPSSKFRDRLTMTRDIHTDTFYLGLNNLRSDDTAIYFCARLEADGDDYSPKMFDYWGQGTRIIVSAASTKG

SEQ ID NO: 199 - protein, 129 aa, Homo sapiens
QVRLVQSGPQMKTPGASLRLSCEVSGYRFLDYFIVWVRQTGGQGFEYVGMINPRGGRPWSSWKFRDRLSLTRDIETDTFYLGLNNLRSDDTAIYFCARLEADGDNYSPKMVDYWGQGTKIIVSPASTKG

SEQ ID NO: 200 - protein, 128 aa, Homo sapiens
QVRLSQSGAAVVKTGASVTISCETEGYNFVNYIIHWVRRPPGRGFEWLGMIDPRNGHPWFAQTVRGRLSLRRDTFKETVYMTLSGLTSDDTGVYFCARNEPQYHSLPGMFDYWGHGTPVTVSSASTKG

SEQ ID NO: 201 - protein, 133 aa, Homo sapiens
QVRLVQSGAQLKKPGASVTVSCEASGYNFVNYIINWVRQTPGRGFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 202 - protein, 129 aa, Homo sapiens
QVRLVQSGPQVKTPGASMRISCEASGYRFQDYIIVWIRQTHGQGFEYVGMINPRGGTPWSSSKFRDRLSLTRDIYTDTFYLGLNNLGSDDTAIYFCARLEADGGDYSPKMFDYWGQGTRIIVSAASTKG

SEQ ID NO: 203 - protein, 133 aa, Homo sapiens; identical to SEQ ID NO: 170

SEQ ID NO: 204 - protein, 129 aa, Homo sapiens
QVRLVQSGPQVKRPGASIRLSCETSGYRFQDYIVAWIRQTRGQRFEFVGMVNPRGGRPWPSSKFRDRVTLTRDIESETFHLGLNDLTSDDTATYFCARLEADGADYSPKMFDFWGQGTKIVVSPASTKG

SEQ ID NO: 205 - protein, 130 aa, Homo sapiens
QVRLEQSGAAVRKPGASVTLSCQASGYNFVNYIIHWVRQRPGLDFEWVGMIDPYRGRPWSAHKFEGRLSLSRDVSTEVLYMTLSSLRSDDTATYFCARAEAESQSHSRPIMFDYWGQGSRVTVSSASTKG

SEQ ID NO: 206 - protein, 130 aa, Homo sapiens; identical to SEQ ID NO: 179

SEQ ID NO: 207 - protein, 128 aa, Homo sapiens
QVRLSQSGAAVMKTGASVTISCETEGFNFVNYIIHWVRRPPGRGFEWLGMIDPRNGHPWFAQTVRGRLSLRRDTFNEIVYMTLSGLTTDDTGLYFCARNEPQYHSLPGMFDYWGQGTPVTVSSASTKG

SEQ ID NO: 208 - protein, 133 aa, Homo sapiens
QVRLSQSGAAMKKPGASVTISCETEGYTFINYIIHWVRQPPGRGFEWLGMIDPRNGRPWFGQSVQGRLSLRRDTYTEVVYMTLSGLTSDDAGLYFCARNEPQYHDGNGHSLPGMFDYWGQGTLVAVSSASTKG

SEQ ID NO: 209 - protein, 133 aa, Homo sapiens
QVRLSQSGAAVVKTGASVTISCETEGYTFVNYIIHWVRQSPGRGFEWLGMIDPRNGHPWFGQRLRGRLSLRRDRSTETVFMTLSGLTSDDTAIYFCARNEPQYYDGSGHSLPGMFDYWGQGTRVVVSSASTKG

SEQ ID NO: 210 - protein, 133 aa, Homo sapiens; identical to SEQ ID NO: 170

SEQ ID NO: 211 - protein, 129 aa, Homo sapiens
QVRLVQSGPQVKTPGASIRLSCEASGYRFLDYFIVWVRQTPGQGFEYVGMINPRGGRPWSSWKFRDRLSLTREIDTDTFYLGLSNLRSDDTAIYFCARLEADGDDYSPKMVDYWGQGTKIIVSAASTKG

SEQ ID NO: 212 - protein, 133 aa, Homo sapiens; identical to SEQ ID NO: 170

SEQ ID NO: 213 - protein, 117 aa, Homo sapiens
QVRLEQSGAAVRTPGASVTLSCQASGYKFVNYIIHWVRQRPGLAFEWVGMIDPYRGRPWSAHSFEGRLSLSRDVSMEILYMTLTSLRSDDTATYFCARAEAESQSHSRPIISTSGAR

SEQ ID NO: 214 - protein, 133 aa, Homo sapiens
QVQFFQSGSSMKKSGASVTISCEATGYNIKNHILHWVRQKPGRGFEWVGMIDPINGRPWFGQAFRGRLTLTRDLSTETFYMSLSGLTSDDTATYFCARREADYHDGNGHTLPGMFDFWGPGTLVTVSSASTKG

SEQ ID NO: 215 - protein, 133 aa, Homo sapiens
QVRLSQSGAAVVKTGASVTISCETEGYTFVNHIIHWVRQPPGRGFEWLGMIDPRNGHPWFGQRLRGRLSLRRDRSTETVFMTLSGLTSDDIGIYFCARNEPQYFDGSGHSLPGMFDYWGQGTRVVVSSASTKG

SEQ ID NO: 216 - protein, 133 aa, Homo sapiens
QVRLSQSGAAVVKTGASVTISCETEGYTFVNYIIHWVRQPPGRGFEWLGMIDPRNGHPWFGQRLQGRLSLRRDRSTETVFMTLSGLTSDDTGIYFCARNEPQYYDGSGHSLPGMFDYWGQGTRVVVSSASTKG

SEQ ID NO: 217 - protein, 129 aa, Homo sapiens
QVRLVQSGPQVKTPGASMRVSCEASGYRFLDYIIVWIRQTHGQHFEYVGMINPRGGTPWPSSKFRDRLSLTRDIHTDTFYLGLNNLGSDDTAIYFCARLEADGDDYSPKMFDHWGQGTRIIVSAASTKG

SEQ ID NO: 218 - protein, 130 aa, Homo sapiens
QVRLEQSGAAVKKPGASVTISCQASGYNFVKFFIHWVRQRPGQGFEWVGMIEPYRGRPWSAGNFQGRLSLSRDVSTETLYMTLNNLRSDDTAVYFCARLEAESDSHSRPIMFDHWGHGSLVTVSSASTKG

SEQ ID NO: 219 - protein, 133 aa, Homo sapiens
QVRLSQSGAAVMKTGASVTISCETEGYNFVNYIIHWVRRPPGRGFEWLGMIDPKNGHPWFAQAVRGRLSLRRDTFNEVVYMTLSGLTSDDTGLYFCARNEPQYHDGNGHSLPGMFDFWGQGTLVTVSSASTKG

SEQ ID NO: 220 - protein, 133 aa, Homo sapiens
QVRLSQSGAAVVKTGASVTISCETEGYTFVNYIIHWVRQPPGRGFEWLGMIDPRNGHPWFGQRFRGRLSLRRDRSTETVFMTLSGLTSDDNGIYFCARNEPQYYDGSGHSLPGMFDYWGQGTRVVVSSASTKG

SEQ ID NO: 221 - protein, 130 aa, Homo sapiens; identical to SEQ ID NO: 171

SEQ ID NO: 222 - protein, 130 aa, Homo sapiens
QVRLEQSGAAVRKPGASVTLSCQASGYNFVNYIIHWVRQRPGLDFEWVGMIDPYRGRPWSAHKFQGRLSLSRDVSTEILYMTLNSLRSDDTATYFCARAEAESQSHSRPIMFDSWGQGSRVTVSSASTKG

SEQ ID NO: 223 - protein, 133 aa, Homo sapiens; identical to SEQ ID NO: 170

SEQ ID NO: 224 - protein, 130 aa, Homo sapiens
QVRLEQSGGALRKPGASVTLSCQASGYNFVKYIIHWVRQRPGLGFEWVGMIDPYRGRPWYAHSFAGRLSLSRDTSTETLYMTLSSLKSDDTATYFCARAEAASDSHSRPIMDWTWRILCLLAVVPASTKG

SEQ ID NO: 225 - protein, 133 aa, Homo sapiens; identical to SEQ ID NO: 170

SEQ ID NO: 226 - protein, 130 aa, Homo sapiens; identical to SEQ ID NO: 184

SEQ ID NO: 227 - protein, 129 aa, Homo sapiens
QVRLVQSGPQVKRPGASIRLSCESSGYRFQDYIVAWIRQTRGQGFEFVGMVNPRGGRPWPSSRFRDRVTLTRDIESETFYLGLNDLTSDDTATYFCARLEADGSDYSPKMFDFWGQGTKIVVSPASTKG

SEQ ID NO: 228 - protein, 133 aa, Homo sapiens
QVRLVQSGAQLKKPGASVTVSCEASGYNFVNYIINWVRQTPGRSFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 229 - protein, 132 aa, Homo sapiens
QVQLVQSGPELMKPGSSVKVSCRASGDNFLTSTFNWLRQAPGQRLEWMGRFIPSLGLITSAPKFSDRLTITADQATLTAYMELTGLTSEDTALYYCARGLCRGGNCRLGPSGWLDPWGRGTQVTVSSASTKG

SEQ ID NO: 230 - protein, 126 aa, Homo sapiens
QVVLIQSGAEVKRPGSSVKVSCKASGGSFPITWVRQAPGHGLEWMGGINPFFGTTNYAQKFQGRVSITADESTSTTYLHLSDLRSEDTAVYFCARENREKWLVLRSWFAPWGQGTLVTVSSASTKG

SEQ ID NO: 231 - protein, 123 aa, Homo sapiens
EESGPGLVKPSQTLSLTCSVSGDSVSSGGYFWSWIRQHPTKGLECLGYVYYTGNTYYNPSLKSPPTIEVAMANNQVSLKLGSVTAADTAVYYCARIKRFRGGNYFDTWGHGLLVTVSSASTKG

SEQ ID NO: 232 - protein, 150 aa, Homo sapiens
LAQLEQSGGGVVKPGGSLRLPCAASGFTFIDYYMAWIRLAPGKGLEWLSYISKNGDYTKYSESLKGRFTISRDNAKNLVILQLNRLRADDTAIYFCARADGLTYFGELLQYIFDLWGQGARVIVSSASTKGPSVFPLAPSSKSTSGHASV

SEQ ID NO: 233 - protein, 128 aa, Homo sapiens
QVQLVQSGAEVKKPGASVKISCKASGYSFRNYAVHWVRQAPGQGLEWMGEINGGNGNTEYSQKSQGRLTITRDISATTAYMELSSLRSDDTAVYYCARVAYVHVVTTRSLDNWGQGTLVTVSSASTKG

SEQ ID NO: 234 - protein, 139 aa, Homo sapiens
QVQIRQSGPGLVKPLETLSLSCIVFGGSFIAYHWTWIRQAPLKGLEWIGDIDQGGDITYSPSLKSRVTMSVDRSKSQFSLKLSSVTAADAAVYYCVRGPPNRYAVTSFTSGTHRERSSYYFDYWGPGTLVTVSSASTKG

SEQ ID NO: 235 - protein, 118 aa, Homo sapiens
KAPATLSLSPGERATLSCRASQSVGSDLAWYQQKPGQAPRLLIYDASNRATAIPARFSGSGSGTDFTLSISSLEPEDFAVYFCQQRYDKITFGQGTRLEIQRTVAAPSVFIFPPSDEQ

SEQ ID NO: 236 - protein, 121 aa, Homo sapiens
FVQLVESGGGVVQPGTSLRLSCTTSGFIFSDYGMHWVRQAAGKGLEWVAVIWHDGSNRFYADSVKGRFTISRDNSKNAVYLEMNNLRVEDTALYYCARTSMDIDYWGQGTPVTVSSASTKG

SEQ ID NO: 237 - protein, 132 aa, Homo sapiens
QVYLVQSGPELKKPGASVKISCKASGYNFPKYAIHWVRQAPGQGLQWMGWINGDNGDARYSQKLQGRVTPSTDTSASVVYMELKRLRSEDTAVYYCARALYPWEIGGVPSTMGDDYWGQGTLITVSSASTKG

SEQ ID NO: 238 - protein, 130 aa, Homo sapiens
QVHLQQWGAGLLKPSETLSLTCAVSGGSFSGFFWTWIRQSPGKGLEWIGEVNHSGFTHSNPSLESRATISVAASNTQFSLRLASVTAADTAIYFCALRYFDWSPFRRDTYGTDVWGQGTTVIVSSASTKG

SEQ ID NO: 239 - protein, 132 aa, Homo sapiens
QVQLVQSGAELKKPGSSVKVSCKASGGTFNNHTFNWVRQAPGQGLEWMGRTIPILGSRDYAKTFQDRVTIIADKSTSTVYLELRRLKSEDTGVYYCATSMYYFDSGGYYRNTDLDKWGQGSLVTVSSASTKG

SEQ ID NO: 240 - protein, 133 aa, Homo sapiens
GLDLEHDGHHKEEPRASVTVSCEASGYNFVNYIIHWVRLTPGRGFEWMGMIDPRRGRPWSAQKFQGRLTLTRDIDSERLYMQLSGLRGDDTAVYFCARQEPDFHDGHGHTLRGMFDSWGQGSPVSVSSASTKG

SEQ ID NO: 241 - protein, 124 aa, Homo sapiens
QVQLVQSGAELKKPGSSVKVSCKASGGTFSNYAINWVRQAPGQGFEWMGGIIPLFATPTYAQKFQGRVRITADDSTSTAYMELSSLRSDDTAVYFCARPNVVRSALDYWGQGTLVTVSSASTKG

SEQ ID NO: 242 - protein, 129 aa, Homo sapiens
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPWSQGTLVTVASASTKG

SEQ ID NO: 243 - protein, 146 aa, Homo sapiens
QVQLQESGPGLVKPSGTLSLTCAVSGASISSRNWWTWVRQPPGKGLEWIGEIYESGATNYNPSLKSRVTISVDKSKNQFSLRLTSVTAADTAVYFCARLMTFGGLIGTLDYWGQGTLVTVLQPPPRAHRYHPRNLLQEHLCARVMP

SEQ ID NO: 244 - protein, 141 aa, Homo sapiens
QVQLVQSGAEVKKPGSSVKVSCKASGGTFSTYAISWVRQAPGQGLEWMGGIIPSFSMSNYAQDFQGRLTITADESTSSVYMELNSLRSEDTAVYYCARDFPRFHRLVGNYDFWRGTLDRFSYMDLWGRGTAVTVSSASTKG

SEQ ID NO: 245 - protein, 132 aa, Homo sapiens
QVHLVQSGAEAKRPGSSVRVSCRASGGDFSSYTLSWVRQAPGQGIEWMGGVVPMLDTVHYAQKFQGRLTLSVDEGTSTAYMELSSLRSEDTAMYYCTRGRQTFRAIWSGPPAVFDIWGQGTLVIVSSASTKG

SEQ ID NO: 246 - protein, 141 aa, Homo sapiens
NGGSLRLSCRVSGFGFHLYEMNWVRQAPGKGLEWISSISGSGESTHYSDSITGRFSMSRDEAKDSLYLQMNNLRVEDTAVYYCTRGFSMGDGTGFSFDTWGRGTMVTVSSGLDTVSLASTKGPSVFPLAPCSRSTSDARLS

SEQ ID NO: 247 - protein, 149 aa, Homo sapiens
AARLDQWGTGLVKPSETLSLKCAVFGVDFPDYTWTWARQAPGKGLEWIGHRDHRGGSSYNPSLSGRATISLDTSKAQFSLHIKSVTVADTATYYCAGAVAGLWFEDAYNWFGPWSQGTLVTVAAASTKGPSVFPLAPSSKSTSGHASVL

SEQ ID NO: 248 - protein, 149 aa, Homo sapiens
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGLWFDETYTWFGPWSQGTRVTVASASTKGPSVFPLAPSSKSTSGTRDLS

SEQ ID NO: 249 - protein, 129 aa, Homo sapiens
QVQLVQSEAEVKKPGSSVKVSCKASGGTFRGYTISWVRQAPGQGLEWMGRIIPILGKAIYAPSFQGRVTLTADKSTGTAYMELSRLRSDDTAVYYCAKVKMRGSSGYYYLFDDWGQGTLVTVSSASTKG

SEQ ID NO: 250 - protein, 122 aa, Homo sapiens
QVHLVQSGAEVKKPGASVKVSCKVSGYTLSELSIHWVRQGPGRGLEWMANFDPEDGETIYAPQFQGRVTLTEDTSTDTAYMQLTSLRSEDTAVYYCATDRYTDTGRWGPGTLVTVSSASTKG

SEQ ID NO: 251 - protein, 129 aa, Homo sapiens
QARLDQWGTGLLKPSETLSLKCAVFGVLFTDYNWTWVRQSPGKGLEWIGHLDHRGGGSYNPSLESRVSISLDYSKAQFSLHLKSVTVADTALYYCAGAVKGFWFDEPSTWFGPWSQGTMVTVASASTKG

SEQ ID NO: 252 - protein, 149 aa, Homo sapiens
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPGVREPWLPSPQPPPRAHRSSPWHPPPRAPLVTATVP

SEQ ID NO: 253 - protein, 129 aa, Homo sapiens
QARLDQWGTGLLKPSETLSLKCAVFGVLFTDYNWTWVRQSPGKELEWIGHLDHRGGGNYNPSLESRVTISLDYSKAQFSLHLKSVTVADTARYYCAGAVKGFWFDDPYTWFGPWSQGTLVTVASASTKG

SEQ ID NO: 254 - protein, 132 aa, Homo sapiens
QVHLVQSGAEAKRPGSSVRVSCRASGGDFSSYTLSWVRQAPGQGLERMGGVVPMLDTVHYAQKFQGRLTLSVDEGTSTAYMELSSLRSEDTAMYYCTRGRQTFRAIWSGPPVVFDIWGQGTLVSVSSASTKG

SEQ ID NO: 255 - protein, 125 aa, Homo sapiens
QFRLVQSGPEVKNPGSSVTVSCKASGGTFSGLGINWVRQAPGQGLEWLGDIKTMYGTTNYAPKFQGRVTITADESTSTSYMELSGLRSEDTAVFYCVRELFGHHPAFGVWGQGTSVIVSSASTKG

SEQ ID NO: 256 - protein, 124 aa, Homo sapiens
QVQLVQSGAEVKKPGASVKVSCKASGYTFTNYGVSWVRQAPGQGLEWMGWISPYSGNTNYAQRLQDRVTMTTDTSTNTAYMELRSLRSDDTAVYYCAARSYYYYSMDVWGQGTTVTVSSASTKG

SEQ ID NO: 257 - protein, 133 aa, Homo sapiens
QVQLVQSGADVKKPGASVKVSCKVSGYTVSELSIHWVRQAPGKGLEWMGGFDPEDGKTVSAQNFQGRVTMTEDKSTGTANMELRSLRSEDTAVYYCATTVQLIVDFCNGGPCYNFDDWGQGTLVTVSSASTKG

SEQ ID NO: 258 - protein, 128 aa, Homo sapiens
QVQLVQSGAEVKKPGSSVKVSCKASGGTLSSYTISWVRQAPGQGLEWMGRLIPLVDITTYAQKFQGRVTITADTSTNTAYMELSNLRSEDTAIYHCATSTMIAAVINDAFDLWGQGTTVTVSSASTKG

SEQ ID NO: 259 - protein, 125 aa, Homo sapiens
QVQLVQSGAEVKKPGASVKVSCKASGNTFTSYGITWVRQAPGQGLEWMGWISAYNGNTNYAQKLQDRLTMTTDTSTSTAYMELRSLRSDDTAVYYCAFSRHYGSGNYDYWGQGTLVTVSSASTKG

SEQ ID NO: 260 - protein, 125 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLPIGSGWYGRDYWGQGTLVTVSSASTKG

SEQ ID NO: 261 - protein, 129 aa, Homo sapiens
  MOD_RES (19)..(19): Any naturally occurring amino acid or not present
  MOD_RES (90)..(90): Any naturally occurring amino acid or not present
EVQLLESGGGLVRPGGSLXLSCSASGFTFNSYAMSWVRQAPGKGLEWVSSVSASGEMTYYADSVRGRFTISRDNANNALHLQMNSLRAEXTAVYYCAKVGGTVWSGYSNYLDYWGPGTLVTVSSASTKG

SEQ ID NO: 262 - protein, 125 aa, Homo sapiens
QVQLVQSGAEVKKPGASVKVSCKPSSNTFTSHYIHWVRQAPGQGLEWMGMINPGGSTRYAPKFQGRVTLTRDTSTRTVYMELSSLRSEDTAVYYCARPQYNLGRDPLDVWGLGTMVTVSSASTKG

SEQ ID NO: 263 - protein, 124 aa, Homo sapiens
EVQLVESGGGLVKPGGSLRLSCADSGFTFRSYSMHWVRQAPGKGLAWVSSISSTSNYIYYADSVKGRFTISRDNAKNSLYLQMNSLRAEDTAVYYCARTFITASWFDSWGQGTLVTVSSASTKG

SEQ ID NO: 264 - protein, 104 aa, Homo sapiens
VSGGRFSNYGLSWVRQAPGQGLEWMGRIVPAINRAKYAQKFQGRVILTADKITDTAYMELRSLRSEDTAIFYCARDPQIEIRGNAFDIWGQGTVVTVSSASTKG

SEQ ID NO: 265 - protein, 128 aa, Homo sapiens
QVQLQESGPGLVKPSGTLSLTCNVYGGSMISYYWSWIRQPPGKGLEWIGHVYNSGNTKYSPSLKNRVTISMDTSRNLFSLKVTSVTPADTAVYYCARADYDNIWDSRGGFDLWGQGTLVTVSSASTKG

SEQ ID NO: 266 - protein, 130 aa, Homo sapiens
QVQLVQLLQSGAEVKKPGSSVKVSCQISGYGFSNYAISWVRQAPGQGLEWLGRIVPAVGMTEYAQKFQGRVTFTADRSTITAYMDLRGLRSDDTAVYYCVRDPQVEVRGNAFDIWGQGTMVTVSSASTKG

SEQ ID NO: 267 - protein, 126 aa, Homo sapiens
QVQLVQSGAEMKKPGASVKVSCKASGHTFTNYYMHWVRQAPGQGLEWMGMINPTGDSTRYAQRFQGRVTMTRDTSTRTVYMELSSLRSDDTAVYYCARAHHDFWRAPVDVWGKGTTVTVSSASTKG

SEQ ID NO: 268 - protein, 130 aa, Homo sapiens
EVQLVQSGAEVKKPGESLRISCKTSGYNFNDDWIAWVRQRPDKGPEWMGIFYPGDSQATYSPSFQGHVTFSADTSISTAYLQWTSLKASDTAIYYCARTRCFGANCFNFMDVWGKGTALTVTVSSASTKG

SEQ ID NO: 269 - protein, 125 aa, Homo sapiens
QVQLQESGPGPVKPSETLSLTCTVSGGSMISYYWSWIRQPPGKGLEWIGYIFTNGRTTYSPSLRSRVTISLDTSTNHFSLRLKSVTAADTAIYYCARLDGEAFRYYLDLWGQGNLVTVSSASTKG

SEQ ID NO: 270 - protein, 99 aa, Homo sapiens
IRSFYWHWIRQSPGKGLEWLGSVFDNGLTTHNPSLKSRLTISEDPSRNQISLKLRSMTAADTAVYYCARGDYDILTSSYQFDYWGQGTLVAVSSASTKG

SEQ ID NO: 271 - protein, 127 aa, Homo sapiens
QVQLQESGPGLVKPSETLSLTCTVFGASIRSFYWHWIRQSPGKGLEWLGSVFDNGLTTYNPSLKNRLSISEDPSRNQISLNLRSMTAADTAVYYCARADYDLLTSSYHFDSWGQGTLVTVSSASTKG

SEQ ID NO: 272 - protein, 125 aa, Homo sapiens
QVQLQESGPGLVKPSETLSLTCTVSGGSISYYYWSWIRQPPGKGLEWIGDIYYSGTTDYNPSLKSRVTISVDTSKNQFSLKLSSVTAADTAVYYCARRRGQRLLAYFDYWGQGSLVTVSSASTKG

SEQ ID NO: 273 - protein, 127 aa, Homo sapiens
QVQLVQSGAEVKKPGASVKVSCKAPGYTFIGHYMHWIRQAPGQGLEWMGWINPNSGDTNYAQTFQGRVTMTRDTSISTAYMELTRLRSDDTAVYYCARDLRPMRGNWAMHVWGEGTTVTVSSASTKG

SEQ ID NO: 274 - protein, 106 aa, Homo sapiens
CTVSGGSISSAGYYWTWIRQHPGKGLEFIGYIYYIGTTYYNPSLKSRLTISIDTSKNQFSLKLSSVTAADTAIYYCARDYTARGRHFFDYWGQGALVTVSSASTKG

SEQ ID NO: 275 - protein, 98 aa, Homo sapiens
SSFAISWVRQAPGQGLEWMGGIIPIFEATSYAQKFQDRLTITTDESTTTAYMDLSSLRSEDTAVYYCARAQGDILTEGYFDYWGQGTLVTVSSASTKG

SEQ ID NO: 276 - protein, 125 aa, Homo sapiens
QVQLVQSGAEVKKPGSSVKVSCKVSFFSNYGISWVRQRPGQGLEWMGRIIPAIDDMTYAQTFRGRVTFSADKFTTTAYMELTGLTFEDTATYFCARDPQVNRRGNCFDHWGQGTLVTVSSASTKG

SEQ ID NO: 277 - protein, 83 aa, Homo sapiens
LEWMGRIIPAIDDVTYAQTFRGRVTFSADKFTTTAYMDLTGLRSEDTATYFCARDPQVNRRGNCFDHWGQGTLVTVSSASTKG

SEQ ID NO: 278 - protein, 126 aa, Homo sapiens
QVQLVQSGAEVKKPGAAVKISCKASRFTFSSYYIHWVRQAPGQGLEWMGIINPSGGSTSNAQKFQDRVTLTRDMSTGTVYMELSRLTSEDTAVYYCATPEPSSIVAPLYYWGQGTLVTVSSASTKG

SEQ ID NO: 279 - protein, 125 aa, Homo sapiens
EVQLLESGGGLVQPGGSLRLSCAVSGFTFGGHAVSWVRQAPGKGLEWLSQISGTGSRTDYADAVKGRFTVSRDNSKKTVYLQMNSLRVEDTALFYCATRSPGGGYAFDIWGQGAMVTVSSASTKG

SEQ ID NO: 280 - protein, 127 aa, Homo sapiens
QVQLQESGPGLVKPSETLSLTCTVSGGSISSAGYYWSWIRQHPEKGLEFIGYIYYLGTTYYNPSLKSRVSISIDTSNNQFSLELSSVSAADTAIYYCARDYTASGRHFFDYWGQGTLVTVSSASTKG

SEQ ID NO: 281 - protein, 124 aa, Homo sapiens
EVQLLESGGALVQPGGSLRLSCAASGFTFSTSSMSWVRQAPGKGLEWVSAIGSGRGSTFYADSVKGRFTISRDNSKNTLSLQMNSLTAEDTATYYCTKTGGLLRFPEVWGKGTTVTVSSASTKG

SEQ ID NO: 282 - protein, 127 aa, Homo sapiens
QVQLVQSGAEVKKPGSSVKVSCKASGGTFSNYAISWVRQAPGQGLEWMGGIIPIFEAASYAQKFQDRLTITTDESTTTAYMDLSSLRSEDTAIYYCARAQGDILTEGYFDYWGQGTLVTVSSASTKG

SEQ ID NO: 283 - protein, 126 aa, Homo sapiens
QVQLQESGPGLVKPSETLSLTCTVSGGSISTYYWSWIRQPPGKGLEWIGYISYSGSTNYNPSLKSRVTISVDTSKNQFSLKLSSVTAADTAVYYCARHKSVLLWFRELDYWGQGTLVTVSSASTKG

SEQ ID NO: 284 - protein, 126 aa, Homo sapiens
QVQLVQSGAEVKKPGSSVKVSCKTSGVRFSSNAISWVRQAPGQGLEWMGRTTPMLGGANHAPSFKGRVTISADESTRTVYMEMSSLRYEDTAVYYCASGRREGLNFLLDYWGQGTLVTVSSASTKG

SEQ ID NO: 285 - protein, 128 aa, Homo sapiens
QVQLVQSGAEVRKPGASVKVSCKTSGYTFTNSYIHWVRQAPGQGLEWMGIINPPGGNTYYAQKFHGRVTLTRDTSTSTVYMELNSLRSEDTAVYFCARPHSPTNIPSRPLDYWGQGTLVTVSSASTKG

SEQ ID NO: 286 - protein, 130 aa, Homo sapiens
QVQLVQSGAEVKKPGASVKVSCKVSGYPLAELSVHWVRQVPGKGLEWVGGFDPEEGKTVYAQKFQGRVTMTEDRSTDTVYMELISLRYEDTAVYYCATDNPVLQLGELSSSLDYWGQGTLVTVSSASTKG

SEQ ID NO: 287 - protein, 115 aa, Homo sapiens
PSETLSLTCRVSGASISNFYWTWIRQPAGKGLEWIGRLYSSDKTNYNPSLNGRVTMSLDTSKNQFSLRLTSMTDADTAIYYCAREKGQWVTLPPYYFDSWGQGILVTVSSASTKG

SEQ ID NO: 288 - protein, 99 aa, Homo sapiens
NTFTSHYVHWVRQAPGQGLEWMGMINPGGTTRYAPKFQDRVTLTRDTSTRTVYMELRSLRSEDTAVYYCARPQYNLGREPLNVWGQGTMVTVSSASTKG

SEQ ID NO: 289 - protein, 128 aa, Homo sapiens
QVQLQESGPGLVKPSETLSLTCSVSGASISNFYWTWIRQPAGKGLEWVGRLYSSDRTNYNPSLNGRVTMSLDTSKNQFSLRLTSMTDADTAIYFCAREKGQWLTVPPYYFDSWGQGILVTVSSASTKG

SEQ ID NO: 290 - protein, 104 aa, Homo sapiens
CTVSGGSIISYYWNWIRQSPGKGLEWLGYIFDGGRANYNPSLRSRLTMSVDTSKNQISLKVKSVTAADSAIYYCARLDGEAFRYYFDSWGQGTLVTVSSASTKG

SEQ ID NO: 291 - protein, 112 aa, Homo sapiens
QTLSLTCSVSGGSISSAGYYWGWIRQHPGKGLEWIGHIYYSGNTNYNPSLKSRLSMSVETSKNQFSLNLASVTAADTAVYFCARDYSAAGRHLFDSWGQGILVTVSSASTKG

SEQ ID NO: 292 - protein, 115 aa, Homo sapiens
KPSQTLSLTCTVSGGSISSAGYYWTWIRHHPGKGLEFIGYIYHIGTPYYNPSLKSRLTISIDTSKNQFSLKLSSVTAADTAIYYCARDYTARGRHFFDYWGQGALVTVSSASTKG

SEQ ID NO: 293 - protein, 128 aa, Homo sapiens
QVQLVQSGADVKKPGASVTVSCKTDEDEDDFRAHLVQWMRQAPGQRLEWVGWIKPQTGQPSYAQKFQGRVTLTREVSTSTVFLQLRNLRSDDTAVYYCARPRGGRDNWSFHVWGRGTLVTVSSASTKG

SEQ ID NO: 294 - protein, 126 aa, Homo sapiens
QVQLVQSGAAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 295 - protein, 126 aa, Homo sapiens
QVQLVQSGAAVKKPGASVKVSCETYGYKFTDHFMHWWRQAPGQGLEWMGWINPYSSAVSYSPRYQGRVTMTRDTFLETVYMELRGLRFDDTAIYYCATPKSGRDYWSFDLWGQGTLVTVSSASTKG

SEQ ID NO: 296 - protein, 126 aa, Homo sapiens
QVQLVQSGAAVKKPGASVKVSCEAYGYKFTDHFMHWWRQAPGQGLEWMGWINPYTSAVNYSPKYQGRVTMTRDTFLETVYMELRGLRVDDTAIYYCATPKSGRDYWSFDLWGQGTLVTVSSASTKG

SEQ ID NO: 297 - protein, 125 aa, Homo sapiens
QVQLQESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 298 - protein, 144 aa, Homo sapiens
LQQLQVPRLSMWRVFKVAAATGAQTLTVEEPGSSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 299 - protein, 132 aa, Homo sapiens
QVHLVQSGAEVKKPGSSVRVSCKASGWTFGDSVNSAITWVRQAPGQGLEWMGRFIPILGLSNYAQKFQDRVTINVDRSTNTAYMELSGLRSEDTAVYYCARLITGMNAPWFYYMDVWGKGTTITVSSASTKG

SEQ ID NO: 300 - protein, 138 aa, Homo sapiens
FICFSVVVRLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 301 - protein, 127 aa, Homo sapiens
QVQLGQSGTEVKKPGFSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 302 - protein, 127 aa, Homo sapiens
QVQLVQSGGEVRKPGSSVKVPCKISGNAFSNYGVNWVRQAPGQGLEWVGRIIPVIGVAQHAPKFQGRVTITADKSTTTAYLELSSLRSDDTAVYFCAKDHGDPRTGYYFDYWGQGALVTVSSASTKG

SEQ ID NO: 303 - protein, 132 aa, Homo sapiens
QVQLLQSGTEVKKPGSSVKVSCRASGWTLGNSPNSAIGWVRQAPGQGLEWIGRIIPILDVTNYAQKFQGRVTISADKSTNIAYMEISSLGSEDTAFYYCARVITGMTSPWYFYMDVWGEGTTVIVSSASTKG

SEQ ID NO: 304 - protein, 134 aa, Homo sapiens
VQSQVYLVQSGGEVKKPGSSVKVSCKASGDSFSSSVITWVRQAPGQGPEWMGRIIPVLGVAAYAQNFYGRVTISADTSSNTAYMELSSLRFEDTAVFYCARETGRGGNLALRQYFFDSWGQGTLVTVSSPSTKG

SEQ ID NO: 305 - protein, 123 aa, Homo sapiens
EVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 306 - protein, 130 aa, Homo sapiens
QVQLVESGGGLVKPGGSLRLSCAASGFSFNEYYMSWIRQAPGQGLEWVANIGSSDAYTIYADSVKGRFTISRDNAENTVYLQMNSLRGEDTAVYYCARIEGYCSNSRCSNYFDPWGQGALVTVSSASTKG

SEQ ID NO: 307 - protein, 145 aa, Homo sapiens
MFLFLVAGATGVQSQVYLVPFGPEVKKPGSSVKVSCKASGDSFTSSVITWVRQAPGQGPEWMGRVIPVLGVAAYAQKFYGRVTITADTSSNTAYMEVNSLRFEDTAVYYCARETGRGGNLALRQYFFDSWGQGTLVTVSSPSTKG

SEQ ID NO: 308 - protein, 133 aa, Homo sapiens
CQVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 309 - protein, 123 aa, Homo sapiens; identical to SEQ ID NO: 305

SEQ ID NO: 310 - protein, 132 aa, Homo sapiens; identical to SEQ ID NO: 299

SEQ ID NO: 311 - protein, 126 aa, Homo sapiens
SGGRLVQPGGSLRLSCSASGFTLSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 312 - protein, 132 aa, Homo sapiens
EVQLVQSGAEVKKPGSSVKVSCKASGGTFTTYDISWVRQAPGQGLEWIGGILPDFGAPSYAQKFQDRVTITTDESSRTAYMELNSLRSEDTAIYYCARGRGDDFWSGESPSWYFDYWGQGTQVTVSSASTKG

SEQ ID NO: 313 - protein, 135 aa, Homo sapiens
PLVQLEPSGVEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 314 - protein, 132 aa, Homo sapiens
QVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 315 - protein, 136 aa, Homo sapiens
EVQLVQSGAEVKKPGASVKVSCKVSGYTLTELSMHWVRQAPGKGLEWMGVFDPLEGDGVYAEKFRGRVIMTEDTSTDTGYMELTSLRSEDTAIYYCATKAKDYYYESSDYSPYYYYYMDVWGKGTTVTVSSASTKG

SEQ ID NO: 316 - protein, 132 aa, Homo sapiens
EVRLLESGGGLVQPGGSLRLSCSASGFTFSNSALSWVRQAPGKGLEWVSSVVSSGGDTFYADSVKGRFTISRDNSRNTLYLQMKSLRAEDTALYYCAKVQIQQLNFGVITDAGMDVWGKGTTVIVSSASTKG

SEQ ID NO: 317 - protein, 117 aa, Homo sapiens
VEEPGSSVKVSCKASGGSSTAYGYSWVRQAPGQGFEWMGRIIPFYGIITYAPKFQGRVTITADRSTSTVYMELTRLTFADTALFFCARDYGDPRNGYYFDSWDQGLWLTVSSASTKG

SEQ ID NO: 318 - protein, 123 aa, Homo sapiens
QVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 319 - protein, 125 aa, Homo sapiens
QVQLVQSGPGLVKPSETLSLTCSVSNGSISSGGYYWSWLRQFPGKGLEWIGSIHYTGRTFYNPSLMGRTALSMDTSNNQFSLKVSSVTAADTALYYCARELQWMFVVDPWGQGTLVTVSSASTKG

SEQ ID NO: 320 - protein, 132 aa, Homo sapiens; identical to SEQ ID NO: 303

SEQ ID NO: 321 - protein, 136 aa, Homo sapiens
QVQLVQSGGEVKKPGASVKVSCKVSGYSLTELSMHWVRQAPGKGLEWMGVFDPLEGDGVYVQKFRGRVIMTEDTSTDTAYMELTSLRSEDTAIYYCATKAKDYYYESSDYSPYYYYYMDVWGKGTTVTVSSASTKG

SEQ ID NO: 322 - protein, 136 aa, Homo sapiens
GSEVQLVESGAEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 323 - protein, 126 aa, Homo sapiens
SVVQLVESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 324 - protein, 134 aa, Homo sapiens
SVDERLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 325 - protein, 133 aa, Homo sapiens
QLQLKESGPGMVKPSETLSLTCSVSGASVVSANDYWGWIRQAPGKGLECIGIILYTGSTFYNPSLQSRVTISRDPSKNHVSLTLTSVTAADSAVYYCARIPYHSESYYNVVIGGFDVWGQGTRVTVSSASTKG

SEQ ID NO: 326 - protein, 132 aa, Homo sapiens; identical to SEQ ID NO: 299

SEQ ID NO: 327 - protein, 127 aa, Homo sapiens; identical to SEQ ID NO: 301

SEQ ID NO: 328 - protein, 126 aa, Homo sapiens
SQVQLVESGPGLVKPSETLSLTCSVSNGSISSGGYYWSWLRQFPGKGLEWIGSIHYTGRTMYNPSLMGRPALSMDTSNNQFSLKLSSVTAADTALYFCARDLQWIFVVDPWGQGTLVTVSSASTKG

SEQ ID NO: 329 - protein, 134 aa, Homo sapiens
RVHSQVQLVESGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 330 - protein, 127 aa, Homo sapiens; identical to SEQ ID NO: 302

SEQ ID NO: 331 - protein, 131 aa, Homo sapiens
QVHLVQSGAEVKKPGSSVRVSCEASGWTFGSVNSAITWVRQAPGQGLEWMGRTIPFLGISNYAQKFQGRVTITADKSTNIAYVDVTSLTSQDTAVYYCARLITGMTAPWFYYMDVWGKGTTVTVSSASTKG

SEQ ID NO: 332 - protein, 130 aa, Homo sapiens
EVQLVQSGSDVKKPGTTVTISCKADEDEDDFTAYNYFMHWVRQAPGQGLEWIGWINPRTGQPNHAKQLQGRVTLTRERSTSTVFMKLTNLRLDDTAVYFCARPLRGGDTWHYHSWGRGTSLIVSSASTKG

SEQ ID NO: 333 - protein, 136 aa, Homo sapiens
QSQVHLVQSGAEVKKPGSSVKVSCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 334 - protein, 128 aa, Homo sapiens
RVQLGQSGAEVKKPGASVKVSCKVSGNSLTEFSIHWVRQAPGKGLEWMGGFDPEEGETVPAQKFKGRVTMTEDTSTNTAYMELSSLRSEDTAVYYCSTEPREMGTLTAGFEYWGQGTLVIVSSASTKG

SEQ ID NO: 335 - protein, 132 aa, Homo sapiens
QPQLVQSGSGAEVKKPGASVRISCEASEYNVFDHFMQWVRQAPMEGLEWMGWINPRGGYPSYSPTFQGRLTFTRQPSWDDSTITFHMELRGLRHDDTAVYYCARPHSPDDAWSLDVWGRGTLVTVSSASTKG

SEQ ID NO: 336 - protein, 136 aa, Homo sapiens
LQPRVHSEVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 337 - protein, 128 aa, Homo sapiens; identical to SEQ ID NO: 334

SEQ ID NO: 338 - protein, 136 aa, Homo sapiens
IWAPLIAVTFLVLHCESLGTCCCCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 339 - protein, 129 aa, Homo sapiens
EVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 340 - protein, 129 aa, Homo sapiens
EVQLVESGAEVKKPGASVKVACKVSGKKLSDLSIHWVRQAPGKGLEWMGGFDEEDGKISYERKFQGRVTMTEDTARDTAFMEMSSLRSDDTAVYFCAAAPRLDLGELSSGFHFWGLGTLVSVSSASTKG

SEQ ID NO: 341 - protein, 136 aa, Homo sapiens
CNPRVHSEVQLVESGAEVKKPGASVKVACKVSGKKLSDLSIHWVRQAPGKGLEWMGGFDEEDGKISYERKFQGRVSMTEDTARDTAFMEMSSLRSDDTAVYFCAAAPRLDLGELSSGFHFWGLGTLVTVSSASTKG

SEQ ID NO: 342 - protein, 128 aa, Homo sapiens
EVQLVESGAEVKKPGASVKVSCKVSGNSLTEFSIHWVRQAPGKGLEWMGGFDPEEGETVPAQKFKGRLTMTEDTSTNTAYMELSSLRSEDTAVYYCSTEPREMGTLTAGFEYWGQGTLVTVSSASTKG

SEQ ID NO: 343 - protein, 125 aa, Homo sapiens
  MOD_RES (18)..(18): Any naturally occurring amino acid or not present
QVQLQESGPGLVKPSETXSLTCSVSNGSISSGGYYWSWLRQFPGKGLEWIGSIHYTGRTMYNPSLMGRPALSMDTSNNQFSLKLSSVTAADTALYFCARDLQWIFVVDPWGQGTLVTVSSASTKG

SEQ ID NO: 344 - protein, 132 aa, Homo sapiens
QVQLVQSGAEVKKPGSSVKVSCKASGGTFTTYDISWVRQAPGQGLEWMGGILPDFGAPSYAQKFQDRVTITTDESSSTAYMELNSLRSEDTAIYYCARGRGDDFWSGESPSWYFDYWGQGTLVTVSSASTKG

SEQ ID NO: 345 - protein, 133 aa, Homo sapiens
GYSEVQLVQSGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 346 - protein, 128 aa, Homo sapiens
QVQLVQSGADVKKPGATVTVSCKTDEDEDDFRAHLMQWMRQAPGQRLEWVGWIKPQTGQPSYGQKFQGRVTLTREVSTSTVFLQLRNLRSDDTAVYYCARPRGGRDNWSFHVWGRGTLVTVSSASTKG

SEQ ID NO: 347 - protein, 128 aa, Homo sapiens; identical to SEQ ID NO: 293

SEQ ID NO: 348 - protein, 126 aa, Homo sapiens; identical to SEQ ID NO: 294

SEQ ID NO: 349 - protein, 126 aa, Homo sapiens; identical to SEQ ID NO: 294

SEQ ID NO: 350 - protein, 126 aa, Homo sapiens; identical to SEQ ID NO: 295

SEQ ID NO: 351 - protein, 126 aa, Homo sapiens; identical to SEQ ID NO: 295

SEQ ID NO: 352 - protein, 126 aa, Homo sapiens; identical to SEQ ID NO: 294

SEQ ID NO: 353 - protein, 126 aa, Homo sapiens; identical to SEQ ID NO: 296

SEQ ID NO: 354 - protein, 126 aa, Homo sapiens
QVQLVQSGGAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 355 - protein, 128 aa, Homo sapiens; identical to SEQ ID NO: 293

SEQ ID NO: 356 - protein, 128 aa, Homo sapiens; identical to SEQ ID NO: 293

SEQ ID NO: 357 - protein, 128 aa, Homo sapiens
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVIVSSASTKG

SEQ ID NO: 358 - protein, 127 aa, Homo sapiens
QVQLLQSGAAVTKPGASVRVSCEASGYNIRDYFIHWWRQAPGQGLQWVGWINPKTGQPNNPCQFQGRVSLTRHASWDFDTFSFYMDLKALRSDDTAVYFCARQRSDYWDFDVWGSGTQVTVSSASTK

SEQ ID NO: 359 - protein, 128 aa, Homo sapiens
QVQLLQSGAAVTKPGASVRVSCEASGYNIRDYFIHWWRQAPGQGLQWVGWINPKTGQPNNPCQFQGRVSLTRQASWDFDTISFYMDLKALRLDDTAVYFCARQRSDYWDFDVWGSGTQVTVSSASTKG

SEQ ID NO: 360 - protein, 128 aa, Homo sapiens
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGSQVTVSSASTKG

SEQ ID NO: 361 - protein, 128 aa, Homo sapiens
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGTQVTVSSASTKG

SEQ ID NO: 362 - protein, 128 aa, Homo sapiens
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGTQVTVSSASTKG

SEQ ID NO: 363 - protein, 128 aa, Homo sapiens
QVHLSQSGAVVTKPGASVRVSCEASGYKISDHFIHWWRQAPGQGPQWVGWINPKTGQPNNPRQFQGRISLTRQASWDFDTFSFYMDLKALRSDDTAVYFCARHRSDYWDFDVWGSGTQVTVSSASTKG

SEQ ID NO: 364 - protein, 128 aa, Homo sapiens
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYRDFDVWGSGTQVTVSSASTKG

SEQ ID NO: 365 - protein, 128 aa, Homo sapiens
QVHLSQSGAAVTKPGASVRVSCEASGYKIRDYSIHWWRQAPGQGLQWVGWINPQTGQPNIPRPFQGRISLTRQASWDFDTFSFYMDLEALRSDDTAVYFCARQRSDYWDFDVWGSGTQVTVSSASTKG

SEQ ID NO: 366 - protein, 128 aa, Homo sapiens
QVHLSQSGAVVTKPGASVRVSCEASGYKISDHFIHWWRQAPGQGLQWVGWINPKTGQPNNPRQFQGRISLTRQASWDFDTFSFYMDLEALRSDDTAVYFCARQRSDYWDFDVWGSGTQVTVSSASTKG

SEQ ID NO: 367 - protein, 128 aa, Homo sapiens
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 368 - protein, 128 aa, Homo sapiens
QVHLSQSGAAVTKPGASVRVSCEASGYKISDHFIHWWRQAPGQGLQWVGWINPKTGQPNNPRQFQGRVSLTRQASWDFDTYSFYMGLKAVRSDDTAIYFCARQRSDFWDFDVWGSGTQVTVSSASTKG

SEQ ID NO: 369 - protein, 128 aa, Homo sapiens
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 370 - protein, 128 aa, Homo sapiens
QVHLSQSGAVVTKPGASVRVSCEASGYKISGHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 371 - protein, 128 aa, Homo sapiens
QVHLSQSGAVVTKPGASVRVSCEASGYKISDHFIHWWRQAPGQGLQWVGWINPKTGQPNIPRQFQGRISLTRQASGDFDTFSFYMDLKALRSDDTAVYFCARQRSDYWDFGVWGSGTQVTVSSASTKG

SEQ ID NO: 372 - protein, 128 aa, Homo sapiens
QVHLSQSGAVVTKPGASVRVSCEASGYKISDHFIHWWRQAPGQGLQWVGWINPKTGQPNNPRQFQGRISLTRQASWDIDTFSFYMDLKALRSDDTAVYFCARHRSDYWDFDVWGSGTQVTVSSASTKG

SEQ ID NO: 373 - protein, 128 aa, Homo sapiens
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 374 - protein, 128 aa, Homo sapiens
QVHLSHSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 375 - protein, 128 aa, Homo sapiens; identical to SEQ ID NO: 367

SEQ ID NO: 376 - protein, 128 aa, Homo sapiens; identical to SEQ ID NO: 367

SEQ ID NO: 377 - protein, 128 aa, Homo sapiens; identical to SEQ ID NO: 369

SEQ ID NO: 378 - protein, 130 aa, Homo sapiens; identical to SEQ ID NO: 332

SEQ ID NO: 379 - protein, 132 aa, Homo sapiens
QPQLVQSGSGAEVKKPGASVRISCEASEYNVFDHFMQWVRQAPGQGLEWMGWINPRGGYPSYSPRFQGRLTFTRQPSWDDSSVTFHMELRGLRHDDTAVYYCARPHSPDDAWSLDVWGRGTLVTVSSASTKG

SEQ ID NO: 380 - protein, 130 aa, Homo sapiens
EVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 381 - protein, 128 aa, Homo sapiens
HVQLLQSGAAVTKPGASVRVSCEASGYNIRDYFIHWWRQAPGQGLQWVGWINPKTGQPNNPRQFQGRVSLTRQASWDFDTFSFYMDLKALRLDDTAIYFCARQRSDYWDFDVWGSGTQVTVSSASTKG

SEQ ID NO: 382 - protein, 130 aa, Homo sapiens
VVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 383 - protein, 124 aa, Homo sapiens
QVQLVQSGAALKKPGASLRISCQAYGYKFTDYLIHWWRQAPGQGLEWIGWIKPETGQPSYSYKFQGRVSLTRDTFEEILFMDLRGLRSDDTAIYFCARRHSDYCDFDVWGGGSQVLVSSASTKG

SEQ ID NO: 384 - protein, 124 aa, Homo sapiens
QVQLVQSGTAVKKPGASVRVSCQASGYTFTDYFIYWWRQAPGQGLEWLGWINPRTSQPSYPYRFQGRVTLTRDIFEEMLYMDLRGLRSDDTGIYFCARRHSDYCDFDIWGSGTQIIVSSASTKG

SEQ ID NO: 385 - protein, 130 aa, Homo sapiens; identical to SEQ ID NO: 380

SEQ ID NO: 386 - protein, 130 aa, Homo sapiens; identical to SEQ ID NO: 380

SEQ ID NO: 387 - protein, 128 aa, Homo sapiens
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKG

SEQ ID NO: 388 - protein, 132 aa, Homo sapiens
QPQLVQSGSGAEVKKPGASVRISCEASEYNVFDHFMQWVRQAPGQGLEWMGWINPRGGYPSYSPTFQGRLTFTRQPSWDDSTITFHMELRGLGHDDTAVYYCARPHSPDDAWSLDVWGRGTLVTVSSASTKG

SEQ ID NO: 389 - protein, 130 aa, Homo sapiens
EVQLVESGSDVRKPGATVTVSCKADEDEDDFTAYNYFMHWVRQAPGQGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 390 - protein, 124 aa, Homo sapiens
QVQLVQSGAALKKPGASLRISCQAYGYKFTDHLIYWWRQAPGQGLEWIGWIKPETGQPSYSYKFQGRVSLTRDTFQEILFMNLRGLRSDDTAIYFCARRHSDYCDFDVWGSGSQILVSSASTKG

SEQ ID NO: 391 - protein, 130 aa, Homo sapiens; identical to SEQ ID NO: 380

SEQ ID NO: 392 - protein, 130 aa, Homo sapiens; identical to SEQ ID NO: 382

SEQ ID NO: 393 - protein, 124 aa, Homo sapiens
QVQLVQSGAALKKPGASVRISCQAYGYKFTDHLIYWWRQAPGQGLEWIGWIKPETGQPSYSYKFQGRVTLTRDTFEEIHFMDLRGLRYDDTATYFCARRHSDYCDFDVWGSGSQVSVSSASTKG

SEQ ID NO: 394 - protein, 130 aa, Homo sapiens
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSRGRGTSLTVSSASTKG

SEQ ID NO: 395 - protein, 132 aa, Homo sapiens; identical to SEQ ID NO: 335

SEQ ID NO: 396 - protein, 124 aa, Homo sapiens
QVQLVQSGATLKKPGASVRISCQAYGYKFTDHLIHWWRQAPGQGLEWIGWIKPETGQPSYAYKFQGRVSLTRDTFEEILFMDLRGLRSDDTAIYFCARRHSDYCDLDVWGGGTQLLVSSASTKG

SEQ ID NO: 397 - protein, 124 aa, Homo sapiens
QVQLVQSGAALKKPGASLRISCLTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 398 - protein, 124 aa, Homo sapiens
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGGGSQVIVSSASTKG

SEQ ID NO: 399 - protein, 124 aa, Homo sapiens
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 400 - protein, 124 aa, Homo sapiens
QVQLVQSGAALKKPGASVRISCQTYGYKFTDHLIHWWRQAPGQGLEWIGWIKPDTGQPSYSSRFQGRVSLTRDTFEEIVFMDLRGLRSDDTAIYFCARRHSDYCDFDVWGSGSQVLVSSASTKG

SEQ ID NO: 401 - protein, 124 aa, Homo sapiens
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 402 - protein, 130 aa, Homo sapiens
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 403 - protein, 130 aa, Homo sapiens; identical to SEQ ID NO: 380

SEQ ID NO: 404 - protein, 128 aa, Homo sapiens
QVQLLQSGAAVTKPGASVRVSCEASGYNIRDYFIHWWRQAPGQGLQWVGWINPKTGQPNNPRQFQGRVSLTRHASWDFDTFSFYMDLKGLRSDDTAIYFCARQRSDYWDFDVWGSGTQVTVSSASTKG

SEQ ID NO: 405 - protein, 130 aa, Homo sapiens
EVQLVQSGSDVRKPGATVTVSCKADEDEDDFTAYDYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 406 - protein, 130 aa, Homo sapiens; identical to SEQ ID NO: 380

SEQ ID NO: 407 - protein, 130 aa, Homo sapiens; identical to SEQ ID NO: 380

SEQ ID NO: 408 - protein, 124 aa, Homo sapiens; identical to SEQ ID NO: 384

SEQ ID NO: 409 - protein, 128 aa, Homo sapiens
QVQLLQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 410 - protein, 130 aa, Homo sapiens; identical to SEQ ID NO: 402

SEQ ID NO: 411 - protein, 130 aa, Homo sapiens; identical to SEQ ID NO: 382

SEQ ID NO: 412 - protein, 124 aa, Homo sapiens
QVQLVQSGAALKKPGASVRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 413 - protein, 130 aa, Homo sapiens; identical to SEQ ID NO: 382

SEQ ID NO: 414 - protein, 125 aa, Homo sapiens
QVQLVQSGAALKKPGASVRISCQAYGYKFTDYLIHWWRQAPGQGLEWIGWIKPETGQPSYSYKFQGRVTLTRDTFEEILFMDLRGLRSDDTAIYFCARRHSDYCDFDVWGSGSQVIVSSASTKGA

SEQ ID NO: 415 - protein, 130 aa, Homo sapiens
EVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 416 - protein, 130 aa, Homo sapiens; identical to SEQ ID NO: 382

SEQ ID NO: 417 - protein, 124 aa, Homo sapiens
QVQLVQSGAALKKPGASVRISCQAYGYKFTDHLIYWWRQAPGQGLEWIGWIKPETGQPSYAYKFQGRVTLTRDTFEEIHFMDLRGVRNDDTATYFCARRHSDYCDFDVWGSGSQVIVSSASTKG

SEQ ID NO: 418 - protein, 130 aa, Homo sapiens; identical to SEQ ID NO: 415

SEQ ID NO: 419 - protein, 124 aa, Homo sapiens
QVQLVQSGTAVKRPGASVRVSCQASGYTFTDYFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 420 - protein, 130 aa, Homo sapiens; identical to SEQ ID NO: 380

SEQ ID NO: 421 - protein, 128 aa, Homo sapiens
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSSASTKG

SEQ ID NO: 422 - protein, 128 aa, Homo sapiens; identical to SEQ ID NO: 361

SEQ ID NO: 423 - protein, 128 aa, Homo sapiens
QVHLSQSGAAVTKPGASVRVSCEASGYKISDHFIHWWRQAPGQGLQWVGWINPKTGQPNNPRQFQGRVSLTRQASWDFDTYSFYMDLKALRSDDTAIYFCARQRSDFWDFDVWGSGTQVTVSSASTKG

SEQ ID NO: 424 - protein, 128 aa, Homo sapiens
QVQLLPFGGAVTKPGASVRVSCEASGYNIRDYFIHWWRQAPGQGLQWVGWINPKTGQPNNPCQFQGRVSLTRPASWDFDTISFYMDLKALRLDDTAVYFCARQRSDYWDFDVWGSGTQVTVSSASTKG

SEQ ID NO: 425 - protein, 124 aa, Homo sapiens
QVQLVQSGAALKKPGASLRISCQTYGYKFTDHLIYWWRQAPGQGLEWIGWIKPETGQPSYSYRFQGRVSLTRDTFEEIAFMDLRGLRSDDTAIYFCARRHTDYCVFDVWGSGSQIIVSSASTKG

SEQ ID NO: 426 - protein, 130 aa, Homo sapiens
QVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 427 - protein, 124 aa, Homo sapiens
QVQLVQSGAALKKPGASLRISCQTYGYKFTDHLIYWWRQAPGQGLEWMGWIKPETGQPSYSYRFQGRVSLTRDTFEEIVFMDLRGLRSDDTAIYFCARRHSDYCDFDVWGSGSQVIVSSASTKG

SEQ ID NO: 428 - protein, 128 aa, Homo sapiens
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVYSASTKG

SEQ ID NO: 429 - protein, 128 aa, Homo sapiens
QVQLLQSGAAVTKPGASVRVSCEASGYNIRDYFIHWWRQAPGQGLQWVGWINPKTGQPNNPRQFQGRVSLTRQASWDFDTISFYMDLKALRLDDTAVYFCARQRSDYWDFDVWGSGTQVTVSSASTKG

SEQ ID NO: 430 - protein, 125 aa, Homo sapiens
RQVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQILVSSASTKG

SEQ ID NO: 431 - protein, 124 aa, Homo sapiens
QVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQVIVSSASTKG

SEQ ID NO: 432 - protein, 130 aa, Homo sapiens; identical to SEQ ID NO: 402

SEQ ID NO: 433 - protein, 128 aa, Homo sapiens; identical to SEQ ID NO: 387

SEQ ID NO: 434 - protein, 124 aa, Homo sapiens
QVQLVQSGTAVKRPGASVRVSCQASGYTFIDHFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 435 - protein, 128 aa, Homo sapiens
QVQLLQSGAVVTKPGASVRVSCEASGYKIRDYFIHWWRQAPGQGLQWVGWINPQTGQPNIPRPFQGRVTLTRHASWDFDTFSFYMDLKALRSDDTAIYFCARRRSDYCDFDVWGSGTHVTVSSASTKG

SEQ ID NO: 436 - protein, 130 aa, Homo sapiens; identical to SEQ ID NO: 380

SEQ ID NO: 437 - protein, 130 aa, Homo sapiens; identical to SEQ ID NO: 402

SEQ ID NO: 438 - protein, 128 aa, Homo sapiens
QVQLLQSGAAVTKPGASVRVSCEASGYNIRDYFIHWWRQAPGQGLQWVGWINPKTGQPNNPRLFQGRVSLTRHASWDFDTFSFYMDLKAVRSDDTAVYFCARQRSDYWDFDVWGSGTQVTVSSASTKG

SEQ ID NO: 439 - protein, 123 aa, Homo sapiens
EIVLTQSPATLSLSPGERATLSCRASQGLNFVVWYQQKRGQAPRLLIHAPSGRAPGVPDRFSARGSGTEFSLVISSVEPDDFAIYYCQEYSSTPYNFGPGTRVDRKRTVAAPSVFIFPPSDEQ

SEQ ID NO: 440 - protein, 123 aa, Homo sapiens
EIVLTQSPATLSLSPGERATLSCRASQGLNFVVWYQQKGGQAPRLLIHGPTDRAPGVPDRFSARGSGTEFSLVISSVEPDDFALYYCQEYSSTPYNFGPGTRVDRKRTVAAPSVFIFPPSDEQ

SEQ ID NO: 441 - protein, 123 aa, Homo sapiens
EIVLTQSPATLSLSPGERATLSCRASQGLNFVVWYQQKRGQAPRLLIHGPSHRAPGVPDRFSARGSGTEFSLVISSVEPDDFAIYYCQEYSSTPYNFGPGTRVDRKRTVAAPSVFIFPPSDEQ

SEQ ID NO: 442 - protein, 123 aa, Homo sapiens
EIVLTQSPATLSLSPGERATLSCRASQGVNFVVWYQQKRGQAPRLLIYGPSNRAPGVPDRFSARGSGTEFSLVISSVEPDDFALYYCQEYSSTPYNFGPGTRVDRKRTVAAPSVFIFPPSDEQ

SEQ ID NO: 443 - protein, 123 aa, Homo sapiens
EIVLTQSPTTLSLSPGERATLSCRASQGVNLVVWYQQKRGQAPRLLIYGPSDRAPGVPDRFSARGSGTEFSLVISSVEPDDFALYYCQEYSSTPYNFGTGTRVDRKRTVAAPSVFIFPPSDEQ

SEQ ID NO: 444 - protein, 123 aa, Homo sapiens
EIVLTQSPATLSLSPGERATLSCRASQGLNFVVWYQQKRGQAPRLLIHAPSDRAPGVPDRFSARGSGTDFSLVISSVEPDDFAIYYCQEYSSTPYNFGPGTRVDRKRTVAAPSVFIFPPSDEQ

SEQ ID NO: 445 - protein, 112 aa, Homo sapiens
EIVLTQSPATLSLSPGERATLSCRASQGVNFVVWYQQKRGQAPRLLIYGPSDRAPGVPDRFSARGSGTEFSLVISSVEPDDFALYYCQEYSSTPYNFGTGTRVDRKRTVAAP

SEQ ID NO: 446 - protein, 111 aa, Homo sapiens
EIVLTQSPATLSLSPGERATLSCRASQGVNFVVWYQQKRGQAPRLLIYGNSDRVPGVPDRFSARGSGTEFSLVISSVEPDDFALYYCQEYSSTPYNFGPGTRVDRKRTVAA

SEQ ID NO: 447 - protein, 126 aa, Homo sapiens
SEIVLTQSPATLSLSPGERATLSCRASQSINNYLAWYQQKPGQAPRLLIYDASNRATGIPARFSGGGSGTDFTLTISSLEPEDFAVYYCQQRANWRLLTFGGGTKVEIKRTVAAPSVFIFPPSDEQ

SEQ ID NO: 448 - protein, 125 aa, Homo sapiens
EIVMTQSPDTLSVSPGERATLSCRASQSVNSNLAWYQQKPGQAPRLLIYGASTRATAVPARFSGSGSGTEFTLTISSLQSEDSAVYYCQQYYQWLSYTFGQGTKLEIKRTVAAPSVFIFPPSDEQ

SEQ ID NO: 449 - protein, 125 aa, Homo sapiens
DIQMTQSPSTLAASIGGTVRVSCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVFIFPPSDEQ

SEQ ID NO: 450 - protein, 126 aa, Homo sapiens
SEIVMTQSPATLSMSPGERATLSCRASLSVNTNLAWYQQKPGQAPRLLIYGASTRATGIPARFSGSGSGTEFTLTISSLQSEDFALYYCQQYNHWPQTFGQGTKVEIKRTVAAPSVFIFPPSDEQK

SEQ ID NO: 451 - protein, 124 aa, Homo sapiens
DIQMTQSPPSLSASVGDRVTITCQASQDINNFLNWYQQKPGKAPRLLIYDASNLESGVSSRFSGSRSGTDFTLTISSLLPEDIATYSCQQYSNLPYTFSQGTKLEIKRTVAAPSVFIFPPSDEQ

SEQ ID NO: 452 - protein, 123 aa, Homo sapiens
DIQMTQSPSSLSASVGDRVTITCQAGQGIGSSLQWYQQKPGKAPKLLVHGASNLHRGVPSRFSGSGFHTTFSLTISGLQRDDFATYFCAVLEFFGPGTKVEIKRTVAAPSVFIFPPSDEQLKS

SEQ ID NO: 453 - protein, 121 aa, Homo sapiens
DIQMTQSPSSLSASVGDRVTITCQAGQGIGSSLQWYQQKPGKAPKLLVHGASNLHRGVPSRFSGSGFHTTFSLTISGLQRDDFATYFCAVVEFFGPGTKVDIKRTVAAPSVFIFPPSDEQL

SEQ ID NO: 454 - protein, 122 aa, Homo sapiens
DIQMTQSPSSLSASVGDRVTITCQASQGIGSSLQWYQQKPGRAPNLLVHGASKLHRGVPSRFSGSGFHTTFSLTISGLQRDDFATYFCAVLEFFGPGTKVEIKRTVAAPSVFIFPPSDEQLK

SEQ ID NO: 455 - protein, 105 aa, Homo sapiens
DIQMTQSPSSLSASVGDRVSINCQAGQGLGSSLNWYQQKPGRAPKLLVHGASNLQRGVPSRFSGSGFHTTFTLTISSLQPDDVATYFCAAFQWFGPGTKVEIKRT

SEQ ID NO: 456 - protein, 102 aa, Homo sapiens
DIQMTQSPSSLSASVGDRVSIHCQAGQGIGSSLNWYQQKPGRAPRLLVHGASNLQRGVPSRFSGSGFHTTFTLTISSLQPDDVATYWCAALEFFGPGTKVEI

SEQ ID NO: 457 - protein, 122 aa, Homo sapiens
DIQMTQSPSSLSASVGDRVTINCQAGQGIGSSLNWYQKKPGRAPKLLVHGASNLQRGVPSRFSGSGFHTTFTLTISSLQPDDVATYFCAVFQWFGPGTKVDIKRTVAAPSVFIFPPSDEQLK

SEQ ID NO: 458 - protein, 120 aa, Homo sapiens
DIQMTQSPSSLSASVGDRVTITCQAGQGIGSSLNWYQQKPGRAPKLLVYGASNLQRGVPSRFSGSGFHTTFTLTISSLQPEDFATYFCSVYEFLGPGTKVEIKRTVAAPSVFIFPPSDEQ

SEQ ID NO: 459 - protein, 120 aa, Homo sapiens
DIQMTQSPSSLSVSVGDRVSITCRATQGIGNSLNWYQQKPGKAPKVLIYGTTKLHGGVPSRFSGGGSGSTGTLTIDSLQPEDIATYFCQLFEFFGPGTKVEIKRTVAAPSVFIFPPSDEQ

SEQ ID NO: 460 - protein, 120 aa, Homo sapiens
DIQMTQSPSSLSASVGDRVTITCQASQGIGSSLQWYQQKPGRAPNLLVHGASNLHRGVPSRFSGSGFHTTFSLTISGLQRDDFATYFCAVLEFFGPGTKVDIKRTVAAPSVFIFPPSDEQ

SEQ ID NO: 461 - protein, 120 aa, Homo sapiens
DIQMTQSPSSLPASVGDTVTITCQAGQGIGSSLQWYQQRPGRAPNLLVYDASNLQRGVPSRFTGTGFHTTFTLTIRGLRPEDFGTYFCASLEFFGPGTKVDIKRTVAAPSVFIFPPSDEQ

SEQ ID NO: 462 - protein, 120 aa, Homo sapiens
YIQMTQSPSSLSASIGDRVTITCQAGQGIGSSLNWYQQKPGKAPKLLVHGASNLQRGVSSRFSGSGFHTTFTLTISSLRPEDVGTYFCEVYEFIGPGTKVDIKRTVAAPSVFIFPPSDEQ

SEQ ID NO: 463 - protein, 120 aa, Homo sapiens
DIQMTQSPSSLSASVGDRVSINCQAGQGIGSSLNWYQQKRGKAPKLLVHGASTLQRGVPSRFSGSGFHTTFTLTISSLQPDDVATYFCESFQWFGPGTKVEIKRTVAAPSVFIFPPSDEQ

SEQ ID NO: 464 - protein, 120 aa, Homo sapiens
DIQMTQSPSSLSASVGDRVTITCQASQGIGSSLQWYQQKPGRAPKLLVHGASNLHRGVPSRFSGSGFHTSFTLTISSLQPDDVATYFCAVLEFFGPGTKVEIKRTVAAPSVFIFPPSDEQ

SEQ ID NO: 465 - protein, 120 aa, Homo sapiens
DIQMTQSPSSLSASVGDRVSIHCQAGQGIGSSLKWYQQKSGRAPRLLVHGASNLQRGVPSRFSGSGFHTTFTLTISSLQPDDVATYWCAVLEFFGPGTKVEIKRTVAAPSVFIFPPSDEQ

SEQ ID NO: 466 - protein, 129 aa, Homo sapiens
QSVLTQPPSASGAPGQRVTISCSGGPSNVGGNYVYWYRQFPGTAPNLLILRDDQRPSGVPDRFSASKSGNSASLAISGLRPDDEAFYFCATYDSDGSVRLFGGGTTLTVLSQPKAAPSVTLFPPSNGGR

SEQ ID NO: 467 - protein, 129 aa, Homo sapiens
QSALTQTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 468 - protein, 125 aa, Homo sapiens
SQAVVTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPP

SEQ ID NO: 469 - protein, 129 aa, Homo sapiens
QTVVTQPPSASGTPGQRVTISCSGGGSNIGGNLVSWYQHFPGAAPKLLIYRNDQRPSGVPDRFSGSKSGTSASLTISGLRSDDEATYFCAAYDCTLSLRLFGGGTTLNVLSQPKAAPSVTLFPPSSEEL

SEQ ID NO: 470 - protein, 129 aa, Homo sapiens
QSALTQPPSVSGTPGQNVTISCSGGGSNVGGNLVSWYQHFPGAAPKLLIHRDNQRPSGVPDRFSVLKSGNSASLAISGPRSDDEAFYFCAVYDSSLSLGLFGGGTKLTVLSQPKAAPSVTLFPPSSEEL

SEQ ID NO: 471 - protein, 130 aa, Homo sapiens
QSALTQPPSASGAPGQRVTISCSGGPSNVGGNYVYWYRQFPGTAPTLLILRDDQRPSGVPDRFSASKSGNSASLAISGLRPDDEGFYFCATYDSDGSIRLFGGGTALTVLSQPKAAPSVTLFPPSSEELK

SEQ ID NO: 472 - protein, 119 aa, Homo sapiens
NFMLTQAPSASGAPGQRVTISCSGGPSNVGGNYVYWYRQYPGTAPKLLILRDDQRPSGVPDRFSASKSGNSASLAISELRPDDEAFYFCATYDSDGSIRLFGGGTALTVLSQPKAAPSV

SEQ ID NO: 473 - protein, 124 aa, Homo sapiens
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPP

SEQ ID NO: 474 - protein, 118 aa, Homo sapiens
QSVLTQPPSASGAPGQRVTISCSGGPSNVGGNYVYWYRQFPGTAPKLLILRDDQRPSGVPDRFSASKSGNSASLAISGLRPDDEAFYFCATYDSDGSIRLFGGGTALTVLSQPKAAPS

SEQ ID NO: 475 - protein, 120 aa, Homo sapiens
QLVLTQPPSVSGTPGQNVTISCSGGGSHVGGNLVSWYQHFPGAAPKLLIHRDNQRPSGVPDRFSALKSGNSASLAISGLRSDDEAFYFCAVYDSSLSLGLFGGGTKLTVLSQPKAAPSVT

SEQ ID NO: 476 - protein, 131 aa, Homo sapiens
RTVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSGVFGTGTKVTVLGQPKANPTVTLFPPSSEEL

SEQ ID NO: 477 - protein, 128 aa, Homo sapiens
QSALTQPPSASGAPGQRVTISCSGGPSNVGGNYVYWYRQFPGTAPKLLILRDDQRPSGVPDRFSASKSGNSASLAISGLRPDDEALYFCATYDSDGSIRLFGGGTALTVLSQPKAAPSVTLFPPGWEE

SEQ ID NO: 478 - protein, 124 aa, Homo sapiens
QPVLTQPPSASGAPGQRVTISCSGGPSNVGGNYVYWYRQFPGTAPNLLILRDDQRPSGVPDRFSASKSGNSASLAITGLRPDDEAFYFCATYDSDGSIRLFGGGTALTVLSQPKAAPSVTLFPP

SEQ ID NO: 479 - protein, 122 aa, Homo sapiens
QSALTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLF

SEQ ID NO: 480 - protein, 129 aa, Homo sapiens; identical to SEQ ID NO: 467

SEQ ID NO: 481 - protein, 129 aa, Homo sapiens
QLVLTQPPSVSATPGQTVTISCSGSGSNVGGNHVYWYRQLPGAAPTLVISKTDHRPSRVPDRFSGSKSGNSASLAISGLRPDDEAAYFCATYDTGLSLRLFGGGTRLAVLSQPKAAPSVTLFPPSSEEL

SEQ ID NO: 482 - protein, 129 aa, Homo sapiens
QSALTQPPATSGTPGQRVTISCSGGGSNVGGNLVSWYQQFPGAAPKLILHRDGQRPSGVPDRFSASKSGTSASLTISGLRSDDEATYFCAAFDSALSLPLFGGGTKLTVLSQPKAAPSVTLFPPSSEEL

SEQ ID NO: 483 - protein, 129 aa, Homo sapiens
QSVLTQVLSVSGTPGQRVIISCSGTSSNVGGNLVSWYQHLPGAAPRLLIHRDDQRPSGVPDRFSGSKSGNSASLVISGLRSDDEADYFCGAYDSTFSLPVFGGGTRLTVLSQPKAAPSVTLFPPSSEEL

SEQ ID NO: 484 - protein, 128 aa, Homo sapiens
NFMLTQPPSVSATPGQTVTISCSGSGSNVGGNHVYWYRQLPGAAPTLVISKTDHRPSRVPDRFSGSKSGNSASLAISGLRPDDEAVYFCATYDTGLSLRLFGGGTRLTVLSQPKAAPSVTQFPPSSEE

SEQ ID NO: 485 - protein, 129 aa, Homo sapiens
QSALTQPPSVSATPGQTVTISCSGSGSNVGGNHVYWYRQLPGAAPTLLISKTNHRPSQVPDRFSASKSGNSASLAISGLRPDDEADYFCGTYDTSLSLRLFGGGTRLTVLSQPKAAPSVTLFPPSSEEL

SEQ ID NO: 486 - protein, 129 aa, Homo sapiens
QSALTQPPSASGTPGQRVTISCSGGGSNIGGNLVSWYQHFPGTAPKLLIYRNDQRPSGVPDRFSGSKSGTSASLTISGLRSDDEATYFCAAYDSSLSLRLFGGGTTLNVLSQPKAAPSVTLFPPSSEEL

SEQ ID NO: 487 - protein, 129 aa, Homo sapiens
QSALTQPPSVSGTPGQNVTISCSGGGSDVGGNLVSWYQHFPGAAPKLLIHRDNQRPSGVPDRFSALKSGNSASLAISGLRSDDEAFYFCAVYDSSLSLGLFGGGTKLTVLSQPKAAPSVTLFPPSSEEL

SEQ ID NO: 488 - protein, 129 aa, Homo sapiens
QAVVTQPPSVSATPGQTVTISCSGSGSNVGGNHVYWYRQLPGAAPTLLISKTNRRPSQVPDRFSGSKSGNSASLAISGLRPDDEADYFCATYDTDLSLRLFGGGTRLTVLSQPKAAPSVTLFPPSSEEL

SEQ ID NO: 489 - protein, 120 aa, Homo sapiens
QSALTQPPAASGAPGQRVTISCSGGGSNVGGNLVSWYQQFPGAAPKLILHRDGQRPSGVPDRFSASKSGTSASLTISGLRSDDEATYFCAAYDSAVSLPVFGGGTKLTVLSQPKAAPLVT

SEQ ID NO: 490 - protein, 128 aa, Homo sapiens
NFMLTQPPSASGTPGQRVTISCSGGGSNIGGNLVSWYQHFPGAAPKLLIYRNDQRPSGVPDRFSGSKSGTSASLAISGLRSDDKATYFCAAYDSTLSLRLFGGGTTLTVLSQPKAAPSVTLFPPSSEE

SEQ ID NO: 491 - protein, 127 aa, Homo sapiens
QSVLTQVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLFPPSSE

SEQ ID NO: 492 - protein, 129 aa, Homo sapiens
QSALTQPPSVSATPGQTVTISCSGSGSNVGGNHVYWYRQLPGAAPTLLISKTDHRPSRVPDRFSASKSGNSASLAISGLRPDDEAIYFCATYDTGLSLRLFGGGTRLTVLSQPKAAPSVTLFPPSSEEL

SEQ ID NO: 493 - protein, 129 aa, Homo sapiens
QSALTRTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 494 - protein, 115 aa, Homo sapiens
QSALTQAPSASGTPGQRVTISCSGGGSNIGGNLVSWYQHFPGAAPKLLIYRNDQRPSGVPDRFSASKSGTSASLAISGLRSDDEATYFCAAYDSTLSLRLFGGGTTLAVLSQPKA

SEQ ID NO: 495 - protein, 129 aa, Homo sapiens
NFMLTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPPSSEEL

SEQ ID NO: 496 - protein, 129 aa, Homo sapiens
QLVLTQPPSVSGAPGQRVTISCSGGPSNVGGNLVYWYKQFPGTAPKLLIRRDDQRPSGVPDRFSGSKSGNSASLTISGLRPDDEAFYFCATYDSQGSTRLFGGGTVLTVLSQPKAAPSVTLFPPSSEEL

SEQ ID NO: 497 - protein, 128 aa, Homo sapiens
QSALTQPPSVSGAPGQRVTISCSGGPSNVGGNYVYWYRQFPGTAPKLLILRDDQRPSGVPDRFSASKSGNSASLAISGLRPDDEAFYFCATYDSQGSFRVFGGGTALTVLSQPKAAPSVTLYPPSSEE

SEQ ID NO: 498 - protein, 129 aa, Homo sapiens
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPPSSEEL

SEQ ID NO: 499 - protein, 123 aa, Homo sapiens
QVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLYAPSSEE

SEQ ID NO: 500 - protein, 117 aa, Homo sapiens
PVTLSASVGDRVTITCRASEDISKYLNWYQHKPGKAPKLLIYTASSLETGVPSRFSGSGSGTDFSLTISSLQPDDFATYYCQQSYTSSVTFGQGTRVEVKRTVAAPSVFIFPPSDEQ

SEQ ID NO: 501 - protein, 124 aa, Homo sapiens
PATLAVSPGERATISCKSSQNLLYSANNQHSLAWYQQRPGQPPKLLLYWASTRLSGVPDRFSGSGSGTDFTLTISNLQAEDVAVYYCQQYYSPPPTFGQGTKVEIRRTVAAPSVFIFPPSDEQL

SEQ ID NO: 502 - protein, 115 aa, Homo sapiens
TLSASVGDRVTITCRASQSINNYLNWYQQKPGKAPKLLIYAASSLQSGVPSRFSGSGSGTDFTLTISSLQPEDFVTYYCQQTYSNPRMFGQGTKVEIKRTVAAPSVFIFPPSDEQ

SEQ ID NO: 503 - protein, 118 aa, Homo sapiens; identical to SEQ ID NO: 235

SEQ ID NO: 504 - protein, 126 aa, Homo sapiens
RGPVTLAVSLGERATITCKSSQSVLVHSNNKNYLSWYQQKPGQPPKLLIYWASTRESGVPERFSGSGSGTDFTLSISSLQAEDVAVYYCHQYFSTPRTFGQGTKVEIKGTVAAPSVFIFPPSDEQL

SEQ ID NO: 505 - protein, 123 aa, Homo sapiens
SEIVLTQSPATLSLSPGESATLSCRASQSLSSSLAWYQQKPGQAPRLLIYDTSDRATGIPARFSGRGSGTDFTLTISSLEPEDFAVYYCQQRSNWAITFGQGTRLEIKRTVAAPSVFIFPPSD

SEQ ID NO: 506 - protein, 123 aa, Homo sapiens
  MOD_RES (18)..(18): Any naturally occurring amino acid or not present
  MOD_RES (35)..(35): Any naturally occurring amino acid or not present
EIVLTQSPGTLSLSPGEXATLSCRASQTISNNYLXWYQQKAGQAPRLLIYGASSGATGIPDRFSGSGSGTDFTLTISRLEPEDFAVYYCQQYGLSPWTFGRGTKVEIKRTVAAPSVFIFPPSD

SEQ ID NO: 507 - protein, 129 aa, Homo sapiens
QSALTQPRSVSGSPGQSVTISCTGTSSDVGAYNYVSWYRQHPGKAPKLMINDVSKRPSGVPDRFSGSKSGNTASLTISGLQAEDEADYYCCSYAGTYSYVFGTGTKVTVLGQPKANPTVTLFPPSSEEL

SEQ ID NO: 508 - protein, 116 aa, Homo sapiens
APVTLSASVGDTVTITCRASQPIATFLNWYQHKPGQAPKLLIYAASTFQRGAPSRYSGSGSGTDFTLTINSLQPEDLATYYCQQTFTDPVTFGQGTRLEIKRTVAAPSVFIFPPSD

SEQ ID NO: 509 - protein, 122 aa, Homo sapiens
DIQMTQSPASLSASVGDRVTITCRASQGISHYLAWYQQKPGKVPRLLIYAASRLQSGVTSRFSGSGSGTEFTLTISSLLPEDAAVYFCQKYDTDPMTFGQGTRLEIKRTVAAPSVFIFPPSD

SEQ ID NO: 510 - protein, 123 aa, Homo sapiens
DIQMTQSPSSLSASIGDRVTITCRANQHIRSFLNWYQQTPGKAPKLLIYAASTLQRGVPSRFSGSGSGTDFTLTITSLEREDLATYYCQQTYTSPITFGQGTRLEIKRTVAAPSVFIFPPSDE

SEQ ID NO: 511 - protein, 124 aa, Homo sapiens
EIVLTQSPGTLSLSPGERATLSCRASQSVSNNYLAWYQQKPGQAPRLLIYGASSRATGIPDRFSGSGSGTDFTLTISRLEPEDFAVYYCQQYATSSLYTFGQGTKLEIKRTVAAPSVFIFPPSD

SEQ ID NO: 512 - protein, 118 aa, Homo sapiens
LSVSLGERATINCKSSQSILYSSDKKNYLAWYQQKIGQPPKLLLYWASTRESGIPDRFSGSGSGSDFTLTISSLQPEDVAVYYCQQYYISPFTFGPGTKVDLKRTVAAPSVFIFPPSD

SEQ ID NO: 513 - protein, 120 aa, Homo sapiens
NFMLTQPASVSGSPGQSITLSCTGTTSDVRDSNFVSWYQQVPGKAPKLIIYDVSARPSGVSFRFSGSKSGNTASLTISGLQAEDEALYYCSSFTPTNTLVFGGGTKLTVLGQPKAAPSVT

SEQ ID NO: 514 - protein, 114 aa, Homo sapiens
SQSVVTQEPSLTVSPGGTVTLTCGPSTGAVTSGFYPHWFQQKPGQAPRALIYSTSNKYSWTPARFSGSLLGGKAVLTLSDVQPDDEAEYYCLLLLYYGGPWIFGGGTKLTVLVS

SEQ ID NO: 515 - protein, 130 aa, Homo sapiens
QAVVTQEPSLTVSPGGTVTLTCASSTGAVTSGFYPHWFQQKPGQAPRALIYSTSNRYSWTPARFSGSLLGGKAALTLSGVQPEDEAEYYCLLLPYYGGPWIFGGGTKLTVLGQPKAAPSVTLFPPSSEEL

SEQ ID NO: 516 - protein, 122 aa, Homo sapiens
EIVMTQSPATLSVSPGDRATLSCRASQSVSTNLAWYQQKPGQAPRLLIYGASTRATGIPATFSGSGFATEFTLTISSLQSEDFAVYYCQQYNNWPPAFGQGTKVEIKRTVAAPSVFIFPPSD

SEQ ID NO: 517 - protein, 130 aa, Homo sapiens
QSVLTQPPSASGSPGQSITISCTGTSSDVGGYNYVSWYQQPPGKAPKVIIYEVSKRPSGVPDRFSGSKSGNTASLTVSGLQAEDEADYYCSSYAGSNNFVFGTGTEVTVVGQPKANPTVTLFPPSSEELL

SEQ ID NO: 518 - protein, 113 aa, Homo sapiens
SLSASVGDRVTITCRASESISFYLNWYQQKPGKAPELLIFATSTLHSGVPSRFSGSGSGTDFTLTISSLQLEDFATYYCQQSSSTPFTFGGGTKVEIKRTVAAPSVFIFPPSD

SEQ ID NO: 519 - protein, 121 aa, Homo sapiens
DIQMTQSPSSLSAYVGDRVTITCRASQNINTYLNWYQQRPGKAPKLLIYAASTLQSGVPSRFSGSGSGTDFTLTISNLETEDFAVYYCQQTYRSVTFGQGTKLEIKRTVAAPSVFIFPPSD

SEQ ID NO: 520 - protein, 111 aa, Homo sapiens
LSAYVGDRVTITCRASQNINTYLNWYQQRPGKAPKLLIYAASTLQSGVPSRFSGSGSGTDFTLTISNLETEDFAVYYCQQTYSSVTFGQGTKLETRRTVAAPSVFIFPPSD

SEQ ID NO: 521 - protein, 125 aa, Homo sapiens
SEIVLTQSPGTLSLSPGERATLSCRASQSVSSSYLAWYQQKPVQAPRLLIYGASSRATGIPDRFSGSGSGTDFTLTISRLEPEDFAVYYCQQYGTLHPRTFGQGTKVEIKRTVAAPSVFIFPPSD

SEQ ID NO: 522 - protein, 122 aa, Homo sapiens
EIVLTQSPGTLSLSPGERATLSCRASQSISSNYLAWYQQKPGQAPRLLIYGASTRATGIPDRFSGSGSGTDFTLSISRLEPEDIAVYYCHQYGSSQRFGQGTKVEIKRTVAAPSVFIFPPSD

SEQ ID NO: 523 - protein, 122 aa, Homo sapiens
DIQMTQSPSSLSASVGDRVTITCRASQSISRYLNWYQQKPGKAPKLLIYAASSLQGGVPSRFSGSGSGTDFTLTISSLQPEDFATYYCQQSSSKPFTFGGGTKVEIKRTVAAPSVFIFPPSD

SEQ ID NO: 524 - protein, 129 aa, Homo sapiens
NFMLTQPASVSGSPGQSITISCSGTGSDIGVYNYVSWYQQHPGKAPRLMIYDVTNRPSGVSNRFSGSKSGFTASLTISGLQGDDEADYYCSSYSSTNTYVFGTGTHVTVLGQPKANPTVTLFPPSSEEL

SEQ ID NO: 525 - protein, 127 aa, Homo sapiens
QSALTQPPSASGTPGQRVTISCSGSYHNIGSNAVNWYQQLPGTAPKLLIYSNDQRPSGVPDRFSGSKSGTSASLAISGLQSEDEADYYCAAWDDSLHVFGTGTKVTVLGQPKANPTVTLFPPSSEEL

SEQ ID NO: 526 - protein, 127 aa, Homo sapiens; identical to SEQ ID NO: 525

SEQ ID NO: 527 - protein, 123 aa, Homo sapiens
DIQMTQSPSSLSASVGDRVTITCRASQDITTYLAWLQQKPGKAPKSLIYSASTVQSGVPSRFSGSGSGTEFTLTISGLQPEDFATYYCQQYNYYPITFGLGTRLEIKRTVAAPSVFIFPPSDE

SEQ ID NO: 528 - protein, 117 aa, Homo sapiens
IILFLVATATGSWAQSALTQPRSVSGSLGQSVTISCTGSSSDVGRYNYVSWYQHHPGKAPKLMISDVNKRPSGVPDRFSGSKSGNTASLTISGLQAEDETDYYCCSYAGSYIWVFGG

SEQ ID NO: 529 - protein, 125 aa, Homo sapiens
EIVLTQSPATLSLSPGERATLSCRASQSVSSYLAWYQQKPGQAPRLLIYDASNRATGIPARFSGSGSDTDFTLTISSLEPEDFAVYYCQQRGIWPLQITFGQGTRLEIKRTVAAPSVFIFPPSDE

SEQ ID NO: 530 - protein, 119 aa, Homo sapiens
LSASVGDRVTITCRASQSIDRYLNWYQQKPGKAPKLLIYAASSLHTDVPSRFSGSGAGTYFTLTITSLQPEDFATYYCQQSHSPSFGQESYSITFGQGTRLEIKRTVAAPSVFIFPPSD

SEQ ID NO: 531 - protein, 115 aa, Homo sapiens
VTLSLSPGERATLSCRASQTISNNYLAWYQQKPGQAPRLLIYGASSGATGLPDRFSGSGSGTDFTLTISRLEPEDFAVYYCHQYALSPWTFGRGTKVEIKRTVAAPSVFIFPPSD

SEQ ID NO: 532 - protein, 144 aa, Homo sapiens
IILFLVATATGVHSDIQMTQSPSSLSASVGDRVTITCRASQSIDRYLNWYQHKPGKAPKLLIYAASNLHTDVPSRFSGSGAGTYFTLTITSLQPEDFATYYCQQSHSPSFGQESYSIAFGQGTRLEIKRTVAAPSVFIFPPSDE

SEQ ID NO: 533 - protein, 113 aa, Homo sapiens
QSVLTQPASVSGSPGQSITISCTGTNSDVGYSYVSWFQQHPGKVPKLLIYDVSRRSSGVSNRFSGSRSGNTASLTISGLRAEDEADYYCGSFTTSLTLVFGGGTKLAVLVSPS

SEQ ID NO: 534 - protein, 124 aa, Homo sapiens
EIVLTQSPGTLSLSPGERATLSCRASQSVSSRYLAWYQQKPGQAPRLIIYDASSRASGIPDRFSGSGSETDFTLTITRLEPEDFAVYYCQLYGTSPKFTFGQGTKLEIKRTVAAPSVFIFPPSD

SEQ ID NO: 535 - protein, 90 aa, Homo sapiens
DVVMTQSPLSLPVTLGQPASISCRSSQSLVYSHGDTYLKCFQQRPGQSPRRPIYKVSNRDSGVPDRFSGSGSGTDFTLKISRVEAEDVGV

SEQ ID NO: 536 - protein, 116 aa, Homo sapiens
GPATLSVSPGERATLSCRASQSLRNNLAWYQQKTGQSPRLLIYAVSTRATGIPPRFSGGGSGTEFTLTIDSLQSEDFAVYFCQQYDSPQWTFGQGTKVEIKRTVAAPSVFIFPPSD

SEQ ID NO: 537 - protein, 120 aa, Homo sapiens
QSVLTQPASVSGSPGQSITISCTGTSNDVGGQNFVSWYQQHPGTAPQLLIYDVTNRPAGVSSRFSGSKSGNTASLTISGLRTEDEADYYCASFTILNGVDYVFGTGTKVTVLLSPSQPYL

SEQ ID NO: 538 - protein, 124 aa, Homo sapiens
EIVLTQSPATLSVSPGERATLSCRAGQSVSSDLAWYQHKPGQAPRLLIYDASKRATGIPARFSGSGSGTDFTLTISSLEPEDFAVYYCQHRTNWPPSITFGQGTRLEIKRTVAAPSVFIFPPSD

SEQ ID NO: 539 - protein, 119 aa, Homo sapiens
EIVLTQSPGTLSLSPGERATLSCRASQSVSSNYLAWYQQKPGQAPRLLIYGASSRATGIPDRFSGSGSGTDFTLSISRLEPEDFAVYYCQQYGTSSCTFGQGTKLEIKRTVAAPSVFIF

SEQ ID NO: 540 - protein, 123 aa, Homo sapiens
EIVLTQSPGTLSLSPGDRAALSCRASETLSGNSLAWYQQKRGQPPRLLIFAASSRATGIPERFSGGGSGTDFTLTITRLEPEDFAVYFCQQYVDAPITFGQGTRLEIKRTVAAPSVFIFPPSD

SEQ ID NO: 541 - protein, 121 aa, Homo sapiens
EIVLTQSPGTLSLSPGERATLSCRASQSVSSNNLAWYQQKPGQAPRLLMSGASSRATGIPDRFSGSGSGTDFTLTISRLEPEDFAVYHCQQYGSSPPTFGQGTKVEIKRTVAAPSVFIFPP

SEQ ID NO: 542 - protein, 119 aa, Homo sapiens
QSVLTQPRSVSGSPGQSVTISCTGTSSDVGGYNYVSWYQQHPGKAPKTMIFDVTKRPSGVPDRFSGSKSGNTASLTISGLQAEDEADYYCSSYAGRNTFYVFGTGTTVTVQVSPSQPPP

SEQ ID NO: 543 - protein, 123 aa, Homo sapiens
EIVLTQSPGTLSLSPGERATLSCRASQSVSSNLAWYAQKPGQAPRLIIYGASSRASAIPDRFRGSGSGTDFTLTISRLEPEDFAVYYCQQYDDAPITFGHGTRLEIKRTVAAPSVFIFPPSDE

SEQ ID NO: 544 - protein, 105 aa, Homo sapiens
DIQMTQSPSSLSASVGDKVTITCQTSAGYLNWYQQRRGRAPKLLMYDGSRLVTGVPSRFSGRRWGTQYNLTIGSLQPEDIATYYCQVYEFFGPGTRLDLKSTVAA

SEQ ID NO: 545 - protein, 104 aa, Homo sapiens
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLKRTVAA

SEQ ID NO: 546 - protein, 121 aa, Homo sapiens
DIQMTQSPSSVSASVGDRVTITCQASRDTDNSLTWYQQKPGRPPKLLIYHVVNLGPGVPSRFSGSASSATQSTLIISDFQPDDVATYFCQNYEFFGPGTKVEIKRTVAAPSVFIFPPSDEQ

SEQ ID NO: 547 - protein, 114 aa, Homo sapiens
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSD

SEQ ID NO: 548 - protein, 114 aa, Homo sapiens; identical to SEQ ID NO: 547

SEQ ID NO: 549 - protein, 114 aa, Homo sapiens
DIQMTQSPSSLSARVGDTVTFTCQANGYLNWYQQRRGKAPKLLIYDGSKLERGVPSRFSGRGWGQEYNLTINNLQPEDIATYFCQVYEFAVPGTRLDLKRTVAAPSVFIFPPSD

SEQ ID NO: 550 - protein, 114 aa, Homo sapiens
DIQMTQSPSSLSARVGDTVTITCQANGYLNWYQQRRGKAPKLLIYDGSKLETGVPSRFTGRRWGQEYNLTINNLQPEDIATYFCQVYEFIVPGTRLDLKRTVAAPSVFIFPPSD

SEQ ID NO: 551 - protein, 114 aa, Homo sapiens
DIQMTHSPSSLSASVGDTVTITCQANGYLNWYQQRRGKAPKLLIYDGSKLETGVPSRFTGRRWGQEYNLTINNLQPEDIATYFCQVYEFIVPGTRLDLKRTVAAPSVFIFPPSD

SEQ ID NO: 552 - protein, 114 aa, Homo sapiens; identical to SEQ ID NO: 550

SEQ ID NO: 553 - protein, 121 aa, Homo sapiens
DIQMTQSPSSLSASVGDRVTITCQASQGISNSLNWYQQKPGKAPRLLIYGTSTLQRGVPSRFSGSGSGTRFTVTINSLQPEDIATYFCQHNEFFGRGTKVDIKRTVAAPSVFIFPPSDEQL

SEQ ID NO: 554 - protein, 120 aa, Homo sapiens
DIQMTQSPSSLSASIGDRVNITCQASRDTGSALNWYQQKVGRPPRLLISAVSNLGAGVPSRFSGRRSGTQSTLTINTLQPEDIATYFCQHYEFFGPGTKVDIKRTVAAPSVFIFPPSDEQ

SEQ ID NO: 555 - protein, 114 aa, Homo sapiens
DIQMTQSPSSLSASVGDTVTFTCQANGYLNWYQQRRGKAPKLLIYDGSRLERGVPSRFSGRRWGQEYNLTINNLQPEDIATYFCQVYEFAVPGTRLDLKRTVAAPSVFIFPPSD

SEQ ID NO: 556 - protein, 115 aa, Homo sapiens
DIQMTQSPSSLSASVGDTVTITCQTNKGYLNWYQQRRGRAPKLLMYDGSKLVTGVPSRFSGRRWGTQYNLTIGSLQPEDIATYYCQVYEFFGPGTRLDLKRTVAAPSVFIFPPSD

SEQ ID NO: 557 - protein, 115 aa, Homo sapiens
DIQMTQSPSSLSARVGDKVTITYQTSAGYLNWYQQRRGRAPKLLMYDGSRLVTGAPSRFSGRRWGTQYNLTIGSLQPEDIATYYCQVYEFFGPGTRLDLKRTVAAPSVFIFPPSD

SEQ ID NO: 558 - protein, 114 aa, Homo sapiens; identical to SEQ ID NO: 547

SEQ ID NO: 559 - protein, 115 aa, Homo sapiens
DIQMTQSPSSLSASVGDTVTINCQTNKGYLNWYQQRRGRAPKLLMYDGSKLVTGVPSRFSGRRWGTQYNLTIGSLQPEDIATYYCQVYEFFGPGTRLDLKRTVAAPSVFIFPPSD

SEQ ID NO: 560 - protein, 115 aa, Homo sapiens
DIQMTQSPSSLSASVGDTVTITCHTNKGYLNWYQQRRGRAPKLLMFDGSKLVTGVPSRFSGRRWGTQYNLTIGSLQPEDIATYYCQVYEVFGPGTRLDLKRTVAAPSVFIFPPSD

SEQ ID NO: 561 - protein, 115 aa, Homo sapiens; identical to SEQ ID NO: 556

SEQ ID NO: 562 - protein, 115 aa, Homo sapiens
DIQMTQSPSSLSASVGDTVTITCQTNKGYLNWYQQRRGRAPKLLMYDGSKLVTGVPSRLSGRRWGTQYNLTIGSLQPEDIATYYCQVYEFFGPGTRLDLKRTVAAPSVFIFPPSD

SEQ ID NO: 563 - protein, 115 aa, Homo sapiens
DIQMTQSPSSLSASVGDTVTITCQTNKGYLNWYQQKRGRAPKLLMYDGSKLVTGVPSRLSGRRWGTQYNLTIGSLQPEDIATYYCQVYEFFGPGTRLDLKRTVAAPSVFIFPPSD

SEQ ID NO: 564 - protein, 115 aa, Homo sapiens; identical to SEQ ID NO: 562

SEQ ID NO: 565 - protein, 115 aa, Homo sapiens; identical to SEQ ID NO: 556

SEQ ID NO: 566 - protein, 115 aa, Homo sapiens; identical to SEQ ID NO: 562

SEQ ID NO: 567 - protein, 114 aa, Homo sapiens
DIQMTQSPSSLSASVGDTVTITCQANGYLNWYQQRRGKAPKLLIYDGSKLERGVPSRFSGRRWGQEYNLTINNLQAEDIATYFCQVYEFAVPGTRLDLKRTVAAPSVFIFPPSD

SEQ ID NO: 568 - protein, 115 aa, Homo sapiens
DIQMTQSPSSLSARVGDKVTITCQTSAGYLNWYQQRRGRAPKLLMYDGSRLVTGVPSRFSGRRWGTQYNLTIGSLQPEDIATYYCQVYEFFGPGTRLDLKRTVAAPSVFIFPPSD

SEQ ID NO: 569 - protein, 114 aa, Homo sapiens
DIQMTQSPSSLSASVGDTVTITCQANGYLNWYQQRRGKAPKLLMYDGSTLERGVPARFSGRRWGQEYNLTINNLQPEDVATYFCQVYEFIVPGTRLDLKRTVAAPSVFIFPPSD

SEQ ID NO: 570 - protein, 115 aa, Homo sapiens
DIQMTQSPSSLSASVGDTVTITCQTNKGYLNWYQQRRGRAPKLLMCDGSKLVTGVPSRFSGRRWGTQYNLTIGSLQPEDIATYYCQVYEFFGPGTRLDLKRTVAAPSVFIFPPSD

SEQ ID NO: 571 - protein, 115 aa, Homo sapiens
DIQMTQSPSSLSASVGDTVTITCQTTKGYLNWYQQRRGRAPKLLMFDGSKLVTGVPSRFSGRRWGTQYNLTIGSLQPEDLATYYCQVYEFFGPGTRLDLKRTVAAPSVFIFPPSD

SEQ ID NO: 572 - protein, 115 aa, Homo sapiens; identical to SEQ ID NO: 560

SEQ ID NO: 573 - protein, 114 aa, Homo sapiens; identical to SEQ ID NO: 550

SEQ ID NO: 574 - protein, 114 aa, Homo sapiens
DIQMTQSPSSLSARVGDTVTFTCQANGYLNWYQQRRGKAPKLLIYDGSKLERGVPSRFSGRRWGQEYNLTINNLQPEDIATYFCQVYEFAVPGTRLDLKRTVAAPSVFIFPPSD

SEQ ID NO: 575 - protein, 115 aa, Homo sapiens; identical to SEQ ID NO: 562

SEQ ID NO: 576 - protein, 114 aa, Homo sapiens
DIQMTQSPSSLSARVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSD

SEQ ID NO: 577 - protein, 113 aa, Homo sapiens
DIQMTQSPSSLSARVGDTVTFTCQANGYLNWYQQRRGKAPKLLIYDGSKLERGVPSRFSGRRWGQEYNLTINNLQPEDIATYFCQVYEFAVPGTRLDLKRTVAAPSVFIFPSD

SEQ ID NO: 578 - protein, 108 aa, Homo sapiens
DIQMTQSPSSLSASVGDTVTINCQTNKGYLNWYQQRRGRAPKLLMYDGSKLVTGVPSRFSGRRWGTQYNLTIGSLQPEDIATYYCQVYEFFGPGTRLDLKRTVAAPSD

SEQ ID NO: 579 - protein, 115 aa, Homo sapiens; identical to SEQ ID NO: 559

SEQ ID NO: 580 - protein, 114 aa, Homo sapiens; identical to SEQ ID NO: 576

SEQ ID NO: 581 - protein, 115 aa, Homo sapiens
DIQMTQSPSSLSASVGDKVTITCQTSAGYLNWYQQRRGRAPKLLMYDGSRLVTGVPSRFSGRRWGTQYNLTIGSLQPEDVATYYCQVYEFFGPGTRLDLKRTVAAPSVFIFPPSD

SEQ ID NO: 582 - protein, 114 aa, Homo sapiens
DIQMTQSPSSLSARVGDTVTITCQANGYLNWYQQRRGKAPKLLIYDGSKLERGVPSRFSGRRWGQEYNLTINNLQPEDIATYFCQVYEFAVPGTRLDLKRTVAAPSVFIFPPSD

SEQ ID NO: 583 - protein, 114 aa, Homo sapiens
DIQMTQSPSSLSASVGDTVTITCQANGYLNWYQQRRGKAPKLLIYDGSKLERGVPSRFSGRRWGQEYNLTINNLQPEDIATYFCQVYEFIVPGTRLDLKRTVAAPSVFIFPPSD

SEQ ID NO: 584 - DNA, 36 bp, Artificial Sequence
  Description of Artificial Sequence: Synthetic forward primer
ctgcaaccggtgtacattctcaagtgcaactggtgc

SEQ ID NO: 585 - DNA, 38 bp, Artificial Sequence
  Description of Artificial Sequence: Synthetic forward primer
ctgcaaccggtgtacattctcaggtccatttgtcacag

SEQ ID NO: 586 - DNA, 33 bp, Artificial Sequence
  Description of Artificial Sequence: Synthetic reverse primer
tgcgaagtcgacgctgacgagacagtgacctgc

SEQ ID NO: 587 - DNA, 32 bp, Artificial Sequence
  Description of Artificial Sequence: Synthetic reverse primer
tgcgaagtcgacgctgaagagacaataatttg

SEQ ID NO: 588 - DNA, 30 bp, Artificial Sequence
  Description of Artificial Sequence: Synthetic reverse primer
tgcgaagtcgacgctgacgagacaataact

SEQ ID NO: 589 - DNA, 35 bp, Artificial Sequence
  Description of Artificial Sequence: Synthetic forward primer
ctgcaaccggtgtacattttcaggggcacttggtg

SEQ ID NO: 590 - DNA, 33 bp, Artificial Sequence
  Description of Artificial Sequence: Synthetic reverse primer
tgcgaagtcgacgctgaggtgacgatgaccgtg

SEQ ID NO: 591 - DNA, 20 bp, Artificial Sequence
  Description of Artificial Sequence: Synthetic forward leader primer
atggactggacctggaggat

SEQ ID NO: 592 - DNA, 20 bp, Artificial Sequence
  Description of Artificial Sequence: Synthetic forward leader primer
atggactggacctggagcat

SEQ ID NO: 593 - DNA, 20 bp, Artificial Sequence
  Description of Artificial Sequence: Synthetic forward leader primer
atggactggacctggacaat

SEQ ID NO: 594 - DNA, 20 bp, Artificial Sequence
  Description of Artificial Sequence: Synthetic forward leader primer
ggccttctctttgtggtggc

SEQ ID NO: 595 - DNA, 20 bp, Artificial Sequence
  Description of Artificial Sequence: Synthetic forward leader primer
atggactggacctggagggt

SEQ ID NO: 596 - DNA, 20 bp, Artificial Sequence
  Description of Artificial Sequence: Synthetic forward leader primer
atggactggatttggaggat

SEQ ID NO: 597 - DNA, 22 bp, Artificial Sequence
  Description of Artificial Sequence: Synthetic forward leader primer
aggttcctctttgtggtggcag

SEQ ID NO: 598 - DNA, 17 bp, Artificial Sequence
  Description of Artificial Sequence: Synthetic forward leader primer
taaaaggtgtccagtgt

SEQ ID NO: 599 - DNA, 17 bp, Artificial Sequence
  Description of Artificial Sequence: Synthetic forward leader primer
taagaggtgtccagtgt

SEQ ID NO: 600 - DNA, 17 bp, Artificial Sequence
  Description of Artificial Sequence: Synthetic forward leader primer
tagaaggtgtccagtgt

SEQ ID NO: 601 - DNA, 24 bp, Artificial Sequence
  Description of Artificial Sequence: Synthetic forward leader primer
gctatttttaaaggtgtccagtgt

SEQ ID NO: 602 - DNA, 17 bp, Artificial Sequence
  Description of Artificial Sequence: Synthetic forward leader primer
tacaaggtgtccagtgt

SEQ ID NO: 603 - DNA, 17 bp, Artificial Sequence
  Description of Artificial Sequence: Synthetic forward leader primer
ttaaagctgtccagtgt

SEQ ID NO: 604 - DNA, 22 bp, Artificial Sequence
  Description of Artificial Sequence: Synthetic forward leader primer
atgaaacacctgtggttcttcc

SEQ ID NO: 605 - DNA, 18 bp, Artificial Sequence
  Description of Artificial Sequence: Synthetic forward leader primer
atgaaacacctgtttctt

SEQ ID NO: 606 - DNA, 20 bp, Artificial Sequence
  Description of Artificial Sequence: Synthetic forward leader primer
atgaagcacctgtggttctt

SEQ ID NO: 607 - DNA, 20 bp, Artificial Sequence
  Description of Artificial Sequence: Synthetic forward leader primer
atgaaacatctgtggttctt

SEQ ID NO: 608 - DNA, 17 bp, Artificial Sequence
  Description of Artificial Sequence: Synthetic forward leader primer
ttctccaaggagtctgt

SEQ ID NO: 609 - DNA, 19 bp, Artificial Sequence
  Description of Artificial Sequence: Synthetic forward leader primer
cctccacagtgagagtctg

SEQ ID NO: 610 - DNA, 21 bp, Artificial Sequence
  Description of Artificial Sequence: Synthetic forward leader primer
atgtctgtctccttcctcatc

SEQ ID NO: 611 - DNA, 21 bp, Artificial Sequence
  Description of Artificial Sequence: Synthetic forward leader primer
ggcagcagcaacaggtgccca

SEQ ID NO: 612 - DNA, 23 bp, Artificial Sequence
  Description of Artificial Sequence: Synthetic reverse constant region primer
ggaaggtgtgcacgccgctggtc

SEQ ID NO: 613 - DNA, 22 bp, Artificial Sequence
  Description of Artificial Sequence: Synthetic reverse constant region primer
gttcggggaagtagtccttgac

SEQ ID NO: 614 - protein, 10 aa, Homo sapiens
RHSDYCDFDV

SEQ ID NO: 615 - protein, 10 aa, Homo sapiens
QRSDFWDFDV

SEQ ID NO: 616 - protein, 10 aa, Homo sapiens
RHSDYCDFDV

SEQ ID NO: 617 - protein, 10 aa, Homo sapiens
RHSDYCDFDV

SEQ ID NO: 618 - protein, 10 aa, Homo sapiens
RHSDYCDFDI

SEQ ID NO: 619 - protein, 10 aa, Homo sapiens
QRSDYWDFDV

SEQ ID NO: 620 - protein, 10 aa, Homo sapiens
QRSDYWDFDV

SEQ ID NO: 621 - protein, 10 aa, Homo sapiens
RHTDYCDFDV

SEQ ID NO: 622 - protein, 10 aa, Homo sapiens
RHSDYCDFDV

SEQ ID NO: 623 - protein, 10 aa, Homo sapiens
QRSDYWDFDV

SEQ ID NO: 624 - protein, 10 aa, Homo sapiens
RHSDYCDFDV

SEQ ID NO: 625 - protein, 10 aa, Homo sapiens
RHSDYCDFDI

SEQ ID NO: 626 - protein, 10 aa, Homo sapiens
RRSDYCDFDV

SEQ ID NO: 627 - protein, 10 aa, Homo sapiens
QRSDYWDFDV

SEQ ID NO: 628 - protein, 10 aa, Homo sapiens
QRSDYWDFDV

SEQ ID NO: 629 - protein, 10 aa, Homo sapiens
RHSDYCDFDV

SEQ ID NO: 630 - protein, 10 aa, Homo sapiens
RHSDYCDFDI

SEQ ID NO: 631 - protein, 10 aa, Homo sapiens
QRSDYWDFDV

SEQ ID NO: 632 - protein, 10 aa, Homo sapiens
RHSDYCDFDV

SEQ ID NO: 633 - protein, 10 aa, Homo sapiens
RHSDYCDFDV

SEQ ID NO: 634 - protein, 10 aa, Homo sapiens
RHSDYCDLDV

SEQ ID NO: 635 - protein, 10 aa, Homo sapiens
RHSDYCDFDV

SEQ ID NO: 636 - protein, 10 aa, Homo sapiens
RHSDYCDFDV

SEQ ID NO: 637 - protein, 10 aa, Homo sapiens
QRSDYWDFDV

SEQ ID NO: 638 - protein, 10 aa, Homo sapiens
QRSDYWDFDV

SEQ ID NO: 639 - protein, 12 aa, Homo sapiens
PLRGGDTWHYHS

SEQ ID NO: 640 - protein, 12 aa, Homo sapiens
PLRGGDTWHYHS

SEQ ID NO: 641 - protein, 12 aa, Homo sapiens
PHSPDDAWSLDV

SEQ ID NO: 642 - protein, 12 aa, Homo sapiens
PHSPDDAWSLDV

SEQ ID NO: 643 - protein, 12 aa, Homo sapiens
PHSPDDAWSLDV

SEQ ID NO: 644 - protein, 12 aa, Homo sapiens
PRGGRDNWSFHV

SEQ ID NO: 645 - protein, 12 aa, Homo sapiens
PKSGRDYWSFDL

SEQ ID NO: 646 - protein, 14 aa, Homo sapiens
ATGYSYGYLDAFDI

SEQ ID NO: 647 - protein, 14 aa, Homo sapiens
EPREMGTLTAGFEY

SEQ ID NO: 648 - protein, 20 aa, Homo sapiens
GQTDLNDDLWSDYSTPGFDY

SEQ ID NO: 649 - protein, 20 aa, Homo sapiens
GQTDLNDDFWSEYSTPGFDY

SEQ ID NO: 650 - protein, 20 aa, Homo sapiens
GEFDSSGFDYESWYPYYMDV

SEQ ID NO: 651 - protein, 15 aa, Homo sapiens
APRLELGELSSGFHY

SEQ ID NO: 652 - protein, 15 aa, Homo sapiens
APRLDLGELSSGFHF

SEQ ID NO: 653 - protein, 15 aa, Homo sapiens
APRLDLGELSSGFHF

SEQ ID NO: 654 - protein, 16 aa, Homo sapiens
DNPLLQSGEFSSSLDN

SEQ ID NO: 655 - protein, 16 aa, Homo sapiens
DNPLLQSGEFSSSLEN

SEQ ID NO: 656 - protein, 13 aa, Homo sapiens
AQGDILTEGYFDY

SEQ ID NO: 657 - protein, 5 aa, Homo sapiens
QVYEF

SEQ ID NO: 658 - protein, 5 aa, Homo sapiens
QVYEF

SEQ ID NO: 659 - protein, 5 aa, Homo sapiens
QVYEF

SEQ ID NO: 660 - protein, 5 aa, Homo sapiens
QVYEV

SEQ ID NO: 661 - protein, 5 aa, Homo sapiens
QVYEF

SEQ ID NO: 662 - protein, 5 aa, Homo sapiens
QVYEF

SEQ ID NO: 663 - protein, 5 aa, Homo sapiens
QVYEF

SEQ ID NO: 664 - protein, 5 aa, Homo sapiens
QVYEF

SEQ ID NO: 665 - protein, 5 aa, Homo sapiens
QVYEF

SEQ ID NO: 666 - protein, 5 aa, Homo sapiens
QVYEF

SEQ ID NO: 667 - protein, 5 aa, Homo sapiens
QVYEF

SEQ ID NO: 668 - protein, 5 aa, Homo sapiens
QVYEF

SEQ ID NO: 669 - protein, 5 aa, Homo sapiens
QVYEF

SEQ ID NO: 670 - protein, 5 aa, Homo sapiens
QVYEF

SEQ ID NO: 671 - protein, 5 aa, Homo sapiens
QVYEF

SEQ ID NO: 672 - protein, 5 aa, Homo sapiens
QVYEF

SEQ ID NO: 673 - protein, 5 aa, Homo sapiens
QVYEF

SEQ ID NO: 674 - protein, 5 aa, Homo sapiens
QVYEF

SEQ ID NO: 675 - protein, 5 aa, Homo sapiens
QVYEV

SEQ ID NO: 676 - protein, 5 aa, Homo sapiens
QVYEF

SEQ ID NO: 677 - protein, 5 aa, Homo sapiens
QVYEF

SEQ ID NO: 678 - protein, 5 aa, Homo sapiens
QVYEF

SEQ ID NO: 679 - protein, 5 aa, Homo sapiens
QVYEF

SEQ ID NO: 680 - protein, 5 aa, Homo sapiens
QVYEF

SEQ ID NO: 681 - protein, 5 aa, Homo sapiens
QHYEF

SEQ ID NO: 682 - protein, 5 aa, Homo sapiens
QHYEF

SEQ ID NO: 683 - protein, 5 aa, Homo sapiens
QHYEF

SEQ ID NO: 684 - protein, 5 aa, Homo sapiens
QQYEF

SEQ ID NO: 685 - protein, 9 aa, Homo sapiens
AAWDDTLYV

SEQ ID NO: 686 - protein, 11 aa, Homo sapiens
QHRSIWPLMCT

SEQ ID NO: 687 - protein, 9 aa, Homo sapiens
GAWDDTLYV

SEQ ID NO: 688 - protein, 16 aa, Homo sapiens
AEAESQSHSRPIMFDF

SEQ ID NO: 689 - protein, 16 aa, Homo sapiens
AEAESQSHSRPIMFDS

SEQ ID NO: 690 - protein, 19 aa, Homo sapiens
QDSDFHDGHGHTLRGMFDS

SEQ ID NO: 691 - protein, 14 aa, Homo sapiens
NEPQYHSLPGMFDY

SEQ ID NO: 692 - protein, 19 aa, Homo sapiens
NEPQYHDGNGHSLPGMFDY

SEQ ID NO: 693 - protein, 19 aa, Homo sapiens
NEPQYYDGSGHSLPGMFDY

SEQ ID NO: 694 - protein, 15 aa, Homo sapiens
LEADGDDYSPKMVDY

SEQ ID NO: 695 - protein, 19 aa, Homo sapiens
READYHDGNGHTLPGMFDF

SEQ ID NO: 696 - protein, 19 aa, Homo sapiens
NEPQYFDGSGHSLPGMFDY

SEQ ID NO: 697 - protein, 19 aa, Homo sapiens
NEPQYYDGSGHSLPGMFDY

SEQ ID NO: 698 - protein, 15 aa, Homo sapiens
LEADGDDYSPKMFDH

SEQ ID NO: 699 - protein, 16 aa, Homo sapiens
LEAESDSHSRPIMFDH

SEQ ID NO: 700 - protein, 19 aa, Homo sapiens
NEPQYHDGNGHSLPGMFDF

SEQ ID NO: 701 - protein, 19 aa, Homo sapiens
NEPQYYDGSGHSLPGMFDY

SEQ ID NO: 702 - protein, 16 aa, Homo sapiens
AEAESQSHSRPIMFDF

SEQ ID NO: 703 - protein, 16 aa, Homo sapiens
AEAASDSHSRPIMFDH

SEQ ID NO: 704 - protein, 15 aa, Homo sapiens
LEADGSDYSPKMFDF

SEQ ID NO: 705 - protein, 15 aa, Homo sapiens
LEADGDDYSPKMFDY

SEQ ID NO: 706 - protein, 19 aa, Homo sapiens
READYHDGNGHTLPGMFDF

SEQ ID NO: 707 - protein, 15 aa, Homo sapiens
LEADGDDYSPKMFDY

SEQ ID NO: 708 - protein, 15 aa, Homo sapiens
LEADGDNYSPKMVDY

SEQ ID NO: 709 - protein, 14 aa, Homo sapiens
NEPQYHSLPGMFDY

SEQ ID NO: 710 - protein, 15 aa, Homo sapiens
LEADGGDYSPKMFDY

SEQ ID NO: 711 - protein, 15 aa, Homo sapiens
LEADGADYSPKMFDF

SEQ ID NO: 712 - protein, 16 aa, Homo sapiens
AEAESQSHSRPIMFDY

SEQ ID NO: 713 - protein, 16 aa, Homo sapiens
AEAASDSHSRPIMFDH

SEQ ID NO: 714 - protein, 16 aa, Homo sapiens
LEAESDSHSRPIMFDH

SEQ ID NO: 715 - protein, 19 aa, Homo sapiens
NEPQYHDDNGHSLPGMIDY

SEQ ID NO: 716 - protein, 16 aa, Homo sapiens
AEAESQSHSRPIMFDS

SEQ ID NO: 717 - protein, 19 aa, Homo sapiens
NEPQYHDGNGHSLPGMFDS

SEQ ID NO: 718 - protein, 18 aa, Homo sapiens
GRQTFRAIWSGPPVVFDI

SEQ ID NO: 719 - protein, 18 aa, Homo sapiens
GRQTFRAIWSGPPAVFDI

SEQ ID NO: 720 - protein, 16 aa, Homo sapiens
AVAGLWFEDAYNWFGP

SEQ ID NO: 721 - protein, 16 aa, Homo sapiens
AVKGLWFDETYTWFGP

SEQ ID NO: 722 - protein, 16 aa, Homo sapiens
AVKGFWFDEPSTWFGP

SEQ ID NO: 723 - protein, 16 aa, Homo sapiens
AVKGFWFDDPYTWFGP

SEQ ID NO: 724 - protein, 16 aa, Homo sapiens
AVKGFWFDEVYNWFGP

SEQ ID NO: 725 - protein, 11 aa, Homo sapiens
AVYDSSLSLGL

SEQ ID NO: 726 - protein, 11 aa, Homo sapiens
ATYDSQRSIRL

SEQ ID NO: 727 - protein, 11 aa, Homo sapiens
ATYDSQGSTRL

SEQ ID NO: 728 - protein, 11 aa, Homo sapiens
AAYDSTFSLPV

SEQ ID NO: 729 - protein, 11 aa, Homo sapiens
AAYDSSLSLRL

SEQ ID NO: 730 - protein, 11 aa, Homo sapiens
ATYDTDLSLRL

SEQ ID NO: 731 - protein, 11 aa, Homo sapiens
AAYDSAVSLPV

SEQ ID NO: 732 - protein, 11 aa, Homo sapiens
AAYDSTLSLRL

SEQ ID NO: 733 - protein, 11 aa, Homo sapiens
AAYDSTFSLPV

SEQ ID NO: 734 - protein, 11 aa, Homo sapiens
ATYDTGLSLRL

SEQ ID NO: 735 - protein, 11 aa, Homo sapiens
ATYDSGWSIRL

SEQ ID NO: 736 - protein, 11 aa, Homo sapiens
AAYDSTLSLRL

SEQ ID NO: 737 - protein, 11 aa, Homo sapiens
AAYDSTLSLRL

SEQ ID NO: 738 - protein, 11 aa, Homo sapiens
ATYDSQGSTRL

SEQ ID NO: 739 - protein, 11 aa, Homo sapiens
ATYDSDGSIRL

SEQ ID NO: 740 - protein, 11 aa, Homo sapiens
ATYDTGLSLRL

SEQ ID NO: 741 - protein, 11 aa, Homo sapiens
AAFDSALSLPL

SEQ ID NO: 742 - protein, 11 aa, Homo sapiens
ATYDTGLSLRL

SEQ ID NO: 743 - protein, 11 aa, Homo sapiens
GTYDTSLSLRL

SEQ ID NO: 744 - protein, 11 aa, Homo sapiens
ATYDSHGSIRL

SEQ ID NO: 745 - protein, 11 aa, Homo sapiens
ATYDSDGSIRL

SEQ ID NO: 746 - protein, 11 aa, Homo sapiens
ATYDSGWSIRL

SEQ ID NO: 747 - protein, 16 aa, Homo sapiens
DGLGEVAPAYLYGIDA

SEQ ID NO: 748 - protein, 16 aa, Homo sapiens
DGLGEVAPAYLYGIDA

SEQ ID NO: 749 - protein, 16 aa, Homo sapiens
DGLGEVAPAYLYGIDA

SEQ ID NO: 750 - protein, 16 aa, Homo sapiens
DGLGELAPAYHYGIDV

SEQ ID NO: 751 - protein, 16 aa, Homo sapiens
DGLGELAPAYQYGIDV

SEQ ID NO: 752 - protein, 16 aa, Homo sapiens
DGLGEVAPDYRYGIDV

SEQ ID NO: 753 - protein, 16 aa, Homo sapiens
DGLGEVAPAYLYGIDA

SEQ ID NO: 754 - protein, 16 aa, Homo sapiens
DGLGEVAPDYRYGIDV

SEQ ID NO: 755 - protein, 20 aa, Homo sapiens
TSTYDQWSGLHHDGVMAFSS

SEQ ID NO: 756 - protein, 11 aa, Homo sapiens
SSGNFEFAFEI

SEQ ID NO: 757 - protein, 11 aa, Homo sapiens
SSGNYDFAYDI

SEQ ID NO: 758 - protein, 11 aa, Homo sapiens
SSGNYDFAFDI

SEQ ID NO: 759 - protein, 18 aa, Homo sapiens
ADRFKVAQDEGLFVIFDY

SEQ ID NO: 760 - protein, 18 aa, Homo sapiens
ADPFKVAQDEGLYVIFDY

SEQ ID NO: 761 - protein, 18 aa, Homo sapiens
ADPFKVAQDEGLYVIFDY

SEQ ID NO: 762 - protein, 18 aa, Homo sapiens
ADPFKVAQDEGLFVIFDY

SEQ ID NO: 763 - protein, 24 aa, Homo sapiens
DRGDTRLLDYGDYEDERYYYGMDV

SEQ ID NO: 764 - protein, 24 aa, Homo sapiens
DRGDTRLLDYGDYEDERYYYGMDV

SEQ ID NO: 765 - protein, 24 aa, Homo sapiens
DRGDTRLLDYGDYEDERYYYGMDV

SEQ ID NO: 766 - protein, 24 aa, Homo sapiens
DRGDTRLLDYGDYEDERYYYGMDV

SEQ ID NO: 767 - protein, 24 aa, Homo sapiens
DRGDTRLLDYGDYEDERYYYGMDV

SEQ ID NO: 768 - protein, 24 aa, Homo sapiens
DRGDTRLLDYGDYEDERYYYGMDV

SEQ ID NO: 769 - protein, 24 aa, Homo sapiens
DRGDTRLLDYGDYEDERYYYGMDV

SEQ ID NO: 770 - protein, 21 aa, Homo sapiens
DRSSAIGYCSSISCYKGSFDI

SEQ ID NO: 771 - protein, 14 aa, Homo sapiens
GGLYCSSISCIMDV

SEQ ID NO: 772 - protein, 14 aa, Homo sapiens
GGLYCSSISCIMDV

SEQ ID NO: 773 - protein, 5 aa, Homo sapiens
NGFDV

SEQ ID NO: 774 - protein, 9 aa, Homo sapiens
QEYSSTPYN

SEQ ID NO: 775 - protein, 9 aa, Homo sapiens
QEYSSTPYN

SEQ ID NO: 776 - protein, 9 aa, Homo sapiens
QEYSSTPYN

SEQ ID NO: 777 - protein, 9 aa, Homo sapiens
QEYSSTPYN

SEQ ID NO: 778 - protein, 9 aa, Homo sapiens
QEYSSTPYN

SEQ ID NO: 779 - protein, 9 aa, Homo sapiens
QEYSSTPYN

SEQ ID NO: 780 - protein, 9 aa, Homo sapiens
QEYSSTPYN

SEQ ID NO: 781 - protein, 9 aa, Homo sapiens
QQYDTYPGT

SEQ ID NO: 782 - protein, 11 aa, Homo sapiens
QSYDRSLRGSV

SEQ ID NO: 783 - protein, 10 aa, Homo sapiens
QQRANWRLLT

SEQ ID NO: 784 - protein, 9 aa, Homo sapiens
QQYSNLPYT

SEQ ID NO: 785 - protein, 10 aa, Homo sapiens
QQYYQWLSYT

SEQ ID NO: 786 - protein, 9 aa, Homo sapiens
QQYNHWPQT

SEQ ID NO: 787 - protein, 9 aa, Homo sapiens
CLKKTSSYV

SEQ ID NO: 788 - protein, 13 aa, Homo sapiens
DGSGDDTSWHLHP

SEQ ID NO: 789 - protein, 13 aa, Homo sapiens
DESGDDLKWHLHP

SEQ ID NO: 790 - protein, 13 aa, Homo sapiens
DGSGDATSWHLHP

SEQ ID NO: 791 - protein, 13 aa, Homo sapiens
DGSGDARDWHLDP

SEQ ID NO: 792 - protein, 13 aa, Homo sapiens
DRRDDDRAWLLDP

SEQ ID NO: 793 - protein, 13 aa, Homo sapiens
DGSGDDTSWHLDP

SEQ ID NO: 794 - protein, 13 aa, Homo sapiens
DGSGDDTSWYLDP

SEQ ID NO: 795 - protein, 13 aa, Homo sapiens
DGSGDARDWHLHP

SEQ ID NO: 796 - protein, 13 aa, Homo sapiens
DGGGDDRTWLLDA

SEQ ID NO: 797 - protein, 13 aa, Homo sapiens
DRRDDGLDWLLDP

SEQ ID NO: 798 - protein, 13 aa, Homo sapiens
DGSGDDTSWHLHP

SEQ ID NO: 799 - protein, 12 aa, Homo sapiens
GGGDGRNWHLHP

SEQ ID NO: 800 - protein, 13 aa, Homo sapiens
DGSGDDRNWHLDP

SEQ ID NO: 801 - protein, 13 aa, Homo sapiens
DESGYDLNWHLDS

SEQ ID NO: 802 - protein, 5 aa, Homo sapiens
AVLEF

SEQ ID NO: 803 - protein, 5 aa, Homo sapiens
AVFQW

SEQ ID NO: 804 - protein, 5 aa, Homo sapiens
AVLEF

SEQ ID NO: 805 - protein, 5 aa, Homo sapiens
AVLEF

SEQ ID NO: 806 - protein, 5 aa, Homo sapiens
QLFEF

SEQ ID NO: 807 - protein, 5 aa, Homo sapiens
AVLEF

SEQ ID NO: 808 - protein, 5 aa, Homo sapiens
AVVEF

SEQ ID NO: 809 - protein, 5 aa, Homo sapiens
AALEF

SEQ ID NO: 810 - protein, 5 aa, Homo sapiens
SVYEF

SEQ ID NO: 811 - protein, 5 aa, Homo sapiens
QLFEF

SEQ ID NO: 812 - protein, 5 aa, Homo sapiens
AVLEF

SEQ ID NO: 813 - protein, 5 aa, Homo sapiens
ASLEF

SEQ ID NO: 814 - protein, 5 aa, Homo sapiens
EVYEF

SEQ ID NO: 815 - protein, 5 aa, Homo sapiens
ESFQW

SEQ ID NO: 816 - protein, 10 aa, Homo sapiens
QRSDYWDFDV

SEQ ID NO: 817 - protein, 18 aa, Homo sapiens
IPYHSESYYKVVIGGFDV

SEQ ID NO: 818 - protein, 13 aa, Homo sapiens
DHGDPRTGYYFDY

SEQ ID NO: 819 - protein, 9 aa, Homo sapiens
GPLLRYLDS

SEQ ID NO: 820 - protein, 22 aa, Homo sapiens
KAKDYYYESSDYSPYYYYYMDV

SEQ ID NO: 821 - protein, 15 aa, Homo sapiens
GSGRWTIGARIYFDN

SEQ ID NO: 822 - protein, 18 aa, Homo sapiens
TPPHYDVLTGYPSSVLEF

SEQ ID NO: 823 - protein, 14 aa, Homo sapiens
ATGYSYGYLDAFDI

SEQ ID NO: 824 - protein, 15 aa, Homo sapiens
EKGQWLTVPPYYFDS

SEQ ID NO: 825 - protein, 14 aa, Homo sapiens
TRCFGANCFNFMDV

SEQ ID NO: 826 - protein, 12 aa, Homo sapiens
PEPSSIVAPLYY

SEQ ID NO: 827 - protein, 13 aa, Homo sapiens
DPQVEVRGNAFDI

SEQ ID NO: 828 - protein, 12 aa, Homo sapiens
PQYNLGRDPLDV

SEQ ID NO: 829 - protein, 14 aa, Homo sapiens
ADYDLLTSSYHFDS

SEQ ID NO: 830 - protein, 12 aa, Homo sapiens
LDGEAFRYYLDL

SEQ ID NO: 831 - protein, 5 aa, Homo sapiens
QVYEF

SEQ ID NO: 832 - protein, 5 aa, Homo sapiens
QQLAT

SEQ ID NO: 833 - protein, 9 aa, Homo sapiens
QQYDDAPIT

SEQ ID NO: 834 - protein, 11 aa, Homo sapiens
QHRTNWPPSIT

SEQ ID NO: 835 - protein, 9 aa, Homo sapiens
QQYGTSSCT

SEQ ID NO: 836 - protein, 9 aa, Homo sapiens
QQYGSSPPT

SEQ ID NO: 837 - protein, 10 aa, Homo sapiens
QQYNNWPPIT

SEQ ID NO: 838 - protein, 9 aa, Homo sapiens
AAWDDTLYV

SEQ ID NO: 839 - protein, 7 aa, Homo sapiens
QQSHSPS

SEQ ID NO: 840 - protein, 7 aa, Homo sapiens
QQYYISP

SEQ ID NO: 841 - protein, 10 aa, Homo sapiens
QQYGTLHPRT

SEQ ID NO: 842 - protein, 9 aa, Homo sapiens
QQTYTSPIT

SEQ ID NO: 843 - protein, 9 aa, Homo sapiens
QQYGLSPWT

SEQ ID NO: 844 - protein, 11 aa, Homo sapiens
LLLPYYGGPWI

SEQ ID NO: 845 - protein, 10 aa, Homo sapiens
SSFTPTNTLV

SEQ ID NO: 846 - protein, 19 aa, Homo sapiens
NEADYHDGNGHSLRGMFDY

SEQ ID NO: 847 - protein, 18 aa, Homo sapiens
GRQTFRAIWSGPPVVFDI

SEQ ID NO: 848 - protein, 17 aa, Homo sapiens
RYFDWSPFRRDTYGTDV

SEQ ID NO: 849 - protein, 17 aa, Homo sapiens
RYLDWSPIGRDTYGTDV

SEQ ID NO: 850 - protein, 18 aa, Homo sapiens
GLCRGGNCRLGPSGWLDP

SEQ ID NO: 851 - protein, 14 aa, Homo sapiens
VAYVHVVTTRSLDN

SEQ ID NO: 852 - protein, 20 aa, Homo sapiens
HEAPRYSYAFRRYYHYGLDV

SEQ ID NO: 853 - protein, 16 aa, Homo sapiens
VISGRITIFYYNYIDV

SEQ ID NO: 854 - protein, 14 aa, Homo sapiens
GTLWFGESGLRLDH

SEQ ID NO: 855 - protein, 18 aa, Homo sapiens
NRRVAMPEAMILSFYMDV

SEQ ID NO: 856 - protein, 18 aa, Homo sapiens
VVPMFSIFGVVKANYFDY

SEQ ID NO: 857 - protein, 19 aa, Homo sapiens
AGLDYNFWNGKGRKGAFDV

SEQ ID NO: 858 - protein, 16 aa, Homo sapiens
GFRGSPFSSGSLYFDS

SEQ ID NO: 859 - protein, 24 aa, Homo sapiens
AVITDLHTFGDYELEDPSYYYMDV

SEQ ID NO: 860 - protein, 9 aa, Homo sapiens
RGRRQIGDY

SEQ ID NO: 861 - protein, 16 aa, Homo sapiens
SYYDFSIGDGNDAFDV

SEQ ID NO: 862 - protein, 19 aa, Homo sapiens
DTTTFTTFGGGPNMGGFDP

SEQ ID NO: 863 - protein, 11 aa, Homo sapiens
AVYDSSLSLGL

SEQ ID NO: 864 - protein, 9 aa, Homo sapiens
QHRSNWPWT

SEQ ID NO: 865 - protein, 9 aa, Homo sapiens
HQYFSTPRT

SEQ ID NO: 866 - protein, 9 aa, Homo sapiens
HQYFNTPRT

SEQ ID NO: 867 - protein, 9 aa, Homo sapiens
QQYEDPPWT

SEQ ID NO: 868 - protein, 9 aa, Homo sapiens
QQTYSNPRM

SEQ ID NO: 869 - protein, 11 aa, Homo sapiens
ASWDDSLSGWV

SEQ ID NO: 870 - protein, 11 aa, Homo sapiens
ASWDNSLSGPV

SEQ ID NO: 871 - protein, 9 aa, Homo sapiens
QQYNSFPPT

SEQ ID NO: 872 - protein, 7 aa, Homo sapiens
QQYGRSP

SEQ ID NO: 873 - protein, 11 aa, Homo sapiens
GTWDSSLSAVL

SEQ ID NO: 874 - protein, 5 aa, Homo sapiens
QQYDS

SEQ ID NO: 875 - protein, 9 aa, Homo sapiens
HQYAYSPRT

SEQ ID NO: 876 - protein, 9 aa, Homo sapiens
QQYKSYSGT

SEQ ID NO: 877 - protein, 10 aa, Homo sapiens
QHSFGSPPWT

SEQ ID NO: 878 - protein, 10 aa, Homo sapiens
AAWDDSFDYV

SEQ ID NO: 879 - protein, 5 aa, Homo sapiens
QQLRT

SEQ ID NO: 880 - protein, 11 aa, Homo sapiens
QQRTIWPPGCS

SEQ ID NO: 881 - protein, 19 aa, Homo sapiens
NEADYHDGNGHSLRGMFDY

SEQ ID NO: 882 - protein, 11 aa, Homo sapiens
GTYDSQGSTRL

SEQ ID NO: 883 - protein, 9 aa, Homo sapiens
QHRSNWPWT

SEQ ID NO: 884 - protein, 9 aa, Homo sapiens
QQSFAVPYT

SEQ ID NO: 885 - protein, 16 aa, Homo sapiens
DGLGEVAPDYRYGIDV

SEQ ID NO: 886 - protein, 13 aa, Homo sapiens
DESGDDLKWHLHP

SEQ ID NO: 887 - protein, 5 aa, Homo sapiens
AAFQW

SEQ ID NO: 888 - protein, 24 aa, Homo sapiens
HSDYCDFDVWGSGSQVIVSSASTK

SEQ ID NO: 889 - protein, 31 aa, Homo sapiens
DGLGEVAPAYLYGIDAWGQGTTVIVTSASTK

SEQ ID NO: 890 - protein, 98 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 891 - protein, 98 aa, Homo sapiens
QVQLVQSGAEVKKPGASVKVSCKASGYTFNSYYMHWVRQAPGQGLEWMGIINPSGGSTSYAQKFQGRVTMTRDTSTSTVYMELSSLRSEDTAVYYCAR

SEQ ID NO: 892 - protein, 112 aa, Homo sapiens
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDV

SEQ ID NO: 893 - protein, 112 aa, Homo sapiens
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDV

SEQ ID NO: 894 - protein, 111 aa, Homo sapiens
SQHLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDP

SEQ ID NO: 895 - protein, 111 aa, Homo sapiens
SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHP

SEQ ID NO: 896 - protein, 114 aa, Homo sapiens
QVRLSQSGGQMKKPGESMRLSCRASGYEFLNCPINWIRLAPGRRPEWMGWLKPRGGAVNYARKFQGRVTMTRDVYSDTAFLELRSLTSDDTAVYFCTRGKYCTARDYYNWDFEH

SEQ ID NO: 897 - protein, 110 aa, Homo sapiens
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEH

SEQ ID NO: 898 - protein, 113 aa, Homo sapiens
QGHLVQSGGGLKKPGTSVTISCLASEYTFNEFVIHWIRQAPGQGPLWLGLIKRSGRLMTAYNFQDRLSLRRDRSTGTVFMELRGLRPDDTAVYYCARDGLGEVAPDYRYGIDV

SEQ ID NO: 899 - protein, 113 aa, Homo sapiens
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDA

SEQ ID NO: 900 - protein, 114 aa, Homo sapiens
QVQLEQSGTAVRKPGASVTLSCQASGYNFVKYIIHWVRQKPGLGFEWVGMIDPYRGRPWSAHKFQGRLSLSRDTSMEILYMTLTSLKSDDTATYFCARAEAASDSHSRPIMFDH

SEQ ID NO: 901 - protein, 117 aa, Homo sapiens
QVRLFQSGAQLKKPGASVTVSCEASGYNFVNYIINWVRQTPGRSFEWVGMIDPRRGRPWSAQKFQGRLTLTRDIDSEKLYMHLSGLRGDDTAVYYCARQDSDFHDGHGHTLRGMFDS

SEQ ID NO: 902 - protein, 121 aa, Homo sapiens
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSS

SEQ ID NO: 903 - protein, 95 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWP

SEQ ID NO: 904 - protein, 95 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLP

SEQ ID NO: 905 - protein, 98 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSG

SEQ ID NO: 906 - protein, 91 aa, Homo sapiens
DIQMTQSPSSLSASVGDTVTITCQANGYLNWYQQRRGKAPKLLIYDGSKLERGVPSRFSGRRWGQEYNLTINNLQPEDIATYFCQVYEFVV

SEQ ID NO: 907 - protein, 91 aa, Homo sapiens
DIQMTQSPSSLSARVGDTVTITCQANGYLNWYQQRRGKAPKLLIYDGSKLERGVPARFSGRRWGQEYNLTINNLQPEDVATYFCQVYEFIV

SEQ ID NO: 908 - protein, 95 aa, Homo sapiens
DIQMTQSPSSLSASVGDRVTITCQAGQGIGSSLQWYQQKPGKAPKLLVHGASNLHRGVPSRFSGSGFHTTFSLTISGLQRDDFATYFCAVLEFFG

SEQ ID NO: 909 - protein, 95 aa, Homo sapiens
DIQMTQSPSSLSASVGDRVTINCQAGQGIGSSLNWYQKKPGRAPKLLVHGASNLQRGVPSRFSGSGFHTTFTLTISSLQPDDVATYFCAVFQWFG

SEQ ID NO: 910 - protein, 93 aa, Homo sapiens
EIVLTQSPATLSLSPGETAIISCRTSQSGSLAWYQQRPGQAPRLVIYSGSTRAAGIPDRFSGSRWGADYNLSISNLESGDFGVYYCQQYEFFG

SEQ ID NO: 911 - protein, 95 aa, Homo sapiens
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQG

SEQ ID NO: 912 - protein, 94 aa, Homo sapiens
EIVLTQSPATLSLSPGERATLSCRASQGLNFVVWYQQKRGQAPRLLIHAPSGRAPGVPDRFSARGSGTEFSLVISSVEPDDFAIYYCQEYSSTP

SEQ ID NO: 913 - protein, 94 aa, Homo sapiens
EIVLTQSPATLSLSPGERATLSCRASQGLNFVVWYQQKGGQAPRLLIHGPTDRAPGVPDRFSARGSGTEFSLVISSVEPDDFALYYCQEYSSTP

SEQ ID NO: 914 - protein, 100 aa, Homo sapiens
QSALTQPPSASGAPGQRVTISCSGGPSNVGGNYVYWYRQFPGTAPTLLILRDDQRPSGVPDRFSASKSGNSASLAISGLRPDDEGFYFCATYDSDGSIRL

SEQ ID NO: 915 - protein, 100 aa, Homo sapiens
NFMLTQVLSVSGTPGQRVIISCSGTSSNVGGNLVSWYQHLPGAAPRLLIHRDDQRPSGVPDRFSGSKSGNSASLVISGLRSDDEADYFCAAYDSTFSLPV

SEQ ID NO: 916 - protein, 98 aa, Homo sapiens
DIQMTQSPSTLAASIGGTVRVSCRASQSITGNWVAWYQQRPGKAPRLLIYRGAALLGGVPSRFSGSAAGTDFTLTIGNLQAKDFGTFYCQQYDTYPGT

SEQ ID NO: 917 - protein, 16 aa, Homo sapiens
DGLGEVAPDYRYGIDV

SEQ ID NO: 918 - protein, 14 aa, Homo sapiens
QSLSWYRPSGYFES

SEQ ID NO: 919 - protein, 24 aa, Homo sapiens
DRGDTRLLDYGDYEDERYYYGMDV

SEQ ID NO: 920 - protein, 20 aa, Homo sapiens
SINAAVPGLEGVYYYYGMAV

SEQ ID NO: 921 - protein, 24 aa, Homo sapiens
DRGDTRLLDYGDYEDERYYYGMDV

SEQ ID NO: 922 - protein, 24 aa, Homo sapiens
DRGDTRLLDYGDYEDERYYYGMDV

SEQ ID NO: 923 - protein, 17 aa, Homo sapiens
WDYYDSRGYYYGEYFDL

SEQ ID NO: 924 - protein, 16 aa, Homo sapiens
DTKVGAPRQDCYAMDL

SEQ ID NO: 925 - protein, 16 aa, Homo sapiens
DGLGEVAPDYRYGIDV

SEQ ID NO: 926 - protein, 18 aa, Homo sapiens
ADRFKVAQDEGLFVIFDY

SEQ ID NO: 927 - protein, 21 aa, Homo sapiens
DRSSAIGYCSSISCYKGSFDI

SEQ ID NO: 928 - protein, 18 aa, Homo sapiens
LAEVPPAIRGSYYYGMDV

SEQ ID NO: 929 - protein, 19 aa, Homo sapiens
AYGTGNWRGLYYYYYGMDV

SEQ ID NO: 930 - protein, 8 aa, Homo sapiens
SPSYYFDY

SEQ ID NO: 931 - protein, 16 aa, Homo sapiens
DGLGEVAPAYLYGIDA

SEQ ID NO: 932 - protein, 14 aa, Homo sapiens
GGLYCSSISCIMDV

SEQ ID NO: 933 - protein, 14 aa, Homo sapiens
GGLYCSSISCIMDV

SEQ ID NO: 934 - protein, 16 aa, Homo sapiens
DGLGEVAPAYLYGIDA

SEQ ID NO: 935 - protein, 18 aa, Homo sapiens
ADRFKVAQDEGLFVIFDY

SEQ ID NO: 936 - protein, 16 aa, Homo sapiens
DGLGEVAPAYLYGIDA

SEQ ID NO: 937 - protein, 11 aa, Homo sapiens
EGGLRFLEWLF

SEQ ID NO: 938 - protein, 12 aa, Homo sapiens
SRPPQRLYGMDV

SEQ ID NO: 939 - protein, 18 aa, Homo sapiens
ADPFKVAQDEGLYVIFDY

SEQ ID NO: 940 - protein, 10 aa, Homo sapiens
DSSGSNWFDY

SEQ ID NO: 941 - protein, 16 aa, Homo sapiens
DGLGEVAPAYLYGIDA

SEQ ID NO: 942 - protein, 5 aa, Homo sapiens
NGFDV

SEQ ID NO: 943 - protein, 18 aa, Homo sapiens
ADPFKVAQDEGLYVIFDY

SEQ ID NO: 944 - protein, 16 aa, Homo sapiens
DGLGEVAPAYLYGIDA

SEQ ID NO: 945 - protein, 16 aa, Homo sapiens
DGLGELAPAYHYGIDV

SEQ ID NO: 946 - protein, 14 aa, Homo sapiens
ARADSHTPIDAFDI

SEQ ID NO: 947 - protein, 16 aa, Homo sapiens
DGLGELAPAYHYGIDV

SEQ ID NO: 948 - protein, 11 aa, Homo sapiens
SSGNFEFAFEI

SEQ ID NO: 949 - protein, 14 aa, Homo sapiens
DRWLPQYYYYGMDV

SEQ ID NO: 950 - protein, 19 aa, Homo sapiens
NPESRCIVGRNRGWCRYFD

SEQ ID NO: 951 - protein, 16 aa, Homo sapiens
DGLGELAPAYQYGIDV

SEQ ID NO: 952 - protein, 19 aa, Homo sapiens
PKFLPGADIVVVVAATPFD

SEQ ID NO: 953 - protein, 16 aa, Homo sapiens
DGLGELAPAYHYGIDV

SEQ ID NO: 954 - protein, 16 aa, Homo sapiens
DGLGEVAPAYLYGIDA

SEQ ID NO: 955 - protein, 5 aa, Homo sapiens
NGFDV

SEQ ID NO: 956 - protein, 18 aa, Homo sapiens
ADPFKVAQDEGLYVIFDY

SEQ ID NO: 957 - protein, 12 aa, Homo sapiens
EMAVGGTKALDH

SEQ ID NO: 958 - protein, 4 aa, Homo sapiens
GVSF

SEQ ID NO: 959 - protein, 8 aa, Homo sapiens
DLLHAHDF

SEQ ID NO: 960 - protein, 13 aa, Homo sapiens
DSVAFVLEGPIDY

SEQ ID NO: 961 - protein, 15 aa, Homo sapiens
YSTRQFFHYYYVTDV

SEQ ID NO: 962 - protein, 16 aa, Homo sapiens
GKVWGITARPRDAGLD

SEQ ID NO: 963 - protein, 12 aa, Homo sapiens
VRDPNYNLHFDS

SEQ ID NO: 964 - protein, 8 aa, Homo sapiens
GLRVYFDL

SEQ ID NO: 965 - protein, 21 aa, Homo sapiens
DRSSAIGYCSSISCYKGSFDI

SEQ ID NO: 966 - protein, 10 aa, Homo sapiens
QKGSGTSLLY

SEQ ID NO: 967 - protein, 15 aa, Homo sapiens
DLLESRTYYNDIRDC

SEQ ID NO: 968 - protein, 24 aa, Homo sapiens
DRGDTRLLDYGDYEDERYYYGMDV

SEQ ID NO: 969 - protein, 9 aa, Homo sapiens
VRGSWNFDY

SEQ ID NO: 970 - protein, 22 aa, Homo sapiens
TYLAVVPDGFDGYSSSWYWFDP

SEQ ID NO: 971 - protein, 21 aa, Homo sapiens
DRSSAIGYCSSISCYKGSFDI

SEQ ID NO: 972 - protein, 12 aa, Homo sapiens
CQDGLASRPIDF

SEQ ID NO: 973 - protein, 13 aa, Homo sapiens
DSVSKSYSAPPEF

SEQ ID NO: 974 - protein, 16 aa, Homo sapiens
DGLGEVAPDYRYGIDV

SEQ ID NO: 975 - protein, 18 aa, Homo sapiens
HVRPYDRSGYPERPNWFD

SEQ ID NO: 976 - protein, 11 aa, Homo sapiens
NAGAYFYPFDI

SEQ ID NO: 977 - protein, 22 aa, Homo sapiens
EMGTFTLLGVVIDHYDFYPMDV

SEQ ID NO: 978 - protein, 18 aa, Homo sapiens
GRGKRCSGAYCFAGYFDS

SEQ ID NO: 979 - protein, 16 aa, Homo sapiens
DGLGEVAPAYLYGIDA

SEQ ID NO: 980 - protein, 112 aa, Homo sapiens
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWG

SEQ ID NO: 981 - protein, 112 aa, Homo sapiens
QVQLVQSGGQMKKPGESMRISCQASGYEFIDCTLNWVRLAPGRRPEWMGWLKPRGGAVNYARPLQGRVTMTRDVYSDTAFLELRSLTADDTAVYYCTRGKNCDYNWDFEHWG

SEQ ID NO: 982 - protein, 116 aa, Homo sapiens
QVRLSQSGGQMKKPGESMRLSCRASGYEFLNCPINWIRLAPGRRPEWMGWLKPRGGAVNYARKFQGRVTMTRDVYSDTAFLELRSLTSDDTAVYFCTRGKYCTARDYYNWDFEHWG

SEQ ID NO: 983 - protein, 112 aa, Homo sapiens
QVRLSQSGGQMKKPGESMRISCRASGYEFIDCTLNWIRLAPGRRPEWMGWLKPRGGAVNYARPLQGRVTMTRDVYSDTAFLELRSLTADDTAVYFCTRGKNCNYNWDFEHWG

SEQ ID NO: 984 - protein, 112 aa, Homo sapiens
QVRLSQSGGQMKKPGESMRISCRASGYEFIDCTLNWIRLAPGRRPEWMGWLKPRGGAVNYARSFQGRVTMTRDVYSDTAFLELRSLTADDTAVYFCARGKNCDYNWDFEHWG

SEQ ID NO: 985 - protein, 94 aa, Homo sapiens
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQ

SEQ ID NO: 986 - protein, 94 aa, Homo sapiens
EIVLTQSPGTLSLSPGETAIISCRTSQYGSLAWYQQRPGQAPRLVIYSGSTRAAGIPDRFSGSRWGPDYNLTIRNLESGDFGLYYCQQYEFFGQ

SEQ ID NO: 987 - protein, 94 aa, Homo sapiens
EIVLTQSPATLSLSPGETAIISCRTSQSGSLAWYQQRPGQAPRLVIYSGSTRAAGIPDRFSGSRWGADYNLSISNLESGDFGVYYCQQYEFFGQ

SEQ ID NO: 988 - protein, 94 aa, Homo sapiens
EIVLTQSPATLSLSPGETAIISCRTSQYGSLAWYQQRPGQAPRLVIYSGSTRAAGIPDRFSGSRWGPDYNLTISNLESGDFGVYYCQQYEFFGQ

SEQ ID NO: 989 - protein, 94 aa, Homo sapiens; identical to SEQ ID NO: 988

SEQ ID NO: 990 - DNA, 294 bp, Homo sapiens
  CDS (1)..(294)
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgaga

SEQ ID NO: 991 - protein, 98 aa, Homo sapiens; identical to SEQ ID NO: 890

SEQ ID NO: 992 - DNA, 306 bp, Homo sapiens
caggtccatttgtcacagtctggggcagcggtgacgaagcccggggcctcagtgagagtctcctgcgaggcttccggatacaagattagtgaccactttattcattggtggcgacaggccccaggacagggccttcagtgggtggggtggatcaatcctaagactggtcagccaaacaatcctcgtcaatttcagggtagagtcagtctgactcgacaggcgtcgtgggactttgacacatattccttttacatggacctcaaggcagtaagatcggacgacacggccatttatttctgtgcgcga

SEQ ID NO: 993 - DNA, 306 bp, Homo sapiens
caggtccaattgttacagtctggggcagcggtgacgaagcccggggcctcagtgagagtctcctgcgaggcttctggatacaacattcgtgactactttattcattggtggcgacaggccccaggacagggccttcagtgggtgggatggatcaatcctaagacaggtcagccaaacaatcctcgtcaatttcagggtagagtcagtctgactcgacacgcgtcgtgggactttgacacattttccttttacatggacctgaaggcactaagatcggacgacacggccgtttatttctgtgcgcga

SEQ ID NO: 994 - DNA, 294 bp, Homo sapiens
caagtgcgactgtcgcagtctggaggtcagatgaagaagcctggcgagtcgatgagactttcctgtcgggcttccggatatgaatttctgaattgtccaataaattggattcgcctggcccccggaagacggcctgagtggatgggatggctgaagcctaggggaggggccgtcaattacgcacgtaaatttcagggcagagtgaccatgactcgagacgtgtattccgacacagcctttttggagttgcgctccttgacatcagacgacacggccgtctatttttgtactagg

SEQ ID NO: 995 - DNA, 294 bp, Homo sapiens
caggtgcagctggtgcagtctggaggtcagatgaagaagcctggcgagtcgatgagaatttcttgtcgggcttctggatatgaatttattgattgtacgctaaattggattcgtctggcccccggaaaaaggcctgagtggatgggatggctgaagcctcgggggggggccgtcaactacgcacgtccacttcagggcagagtgaccatgactcgagacgtttattccgacacagcctttttggagctgcgctcgttgacagtagacgacacggccgtctacttttgtactagg

SEQ ID NO: 996 - DNA, 294 bp, Homo sapiens
tcccagcatttggtgcaatctgggactcaggtgaagaagcctggggcctcagtgaggatctcatgccaggcttctggatacagcttcaccgactacgttctccactggtggcgacaggccccaggccaagggctggagtggatggggtggatcaagcctgtctacggtgccagaaactacgcgcgcaggtttcagggcaggataaactttgatcgggacatctacagggagatagccttcatggacttgagtggactgagatctgacgacacggccctatatttttgtgcgaga

SEQ ID NO: 997 - DNA, 294 bp, Homo sapiens
tcccagcatttggtgcaatctgggactcaggtgaagaagcctggggcctcagtgcgggtctcctgccaggcttctggatataccttcaccaattacattctccactggtggcgacaggcccctggacaagggctggagtggatgggattgatcaagcctgtctttggtgccgtaaattacgcgcgccagtttcagggcaggattcagttgactagggacatctacagggagatagccttcctggacctgagtggcctcagatctgacgacacggccgtctattactgtgcgcga

SEQ ID NO: 998 - DNA, 294 bp, Homo sapiens
  CDS (1)..(294)
caggtgcagctggtgcagtctggggctgaggtgaagaagcctggggcctcagtgaaggtttcctgcaaggcatctggatacaccttcaacagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgaga

SEQ ID NO: 999 - protein, 98 aa, Homo sapiens; identical to SEQ ID NO: 891

SEQ ID NO: 1000 - DNA, 291 bp, Homo sapiens
caggggcacttggtgcagtccgggggtggactgaagaaacctgggacgtcagtgacgatttcctgcctggcatctgaatacacattcaacgaattcgttattcactggattcgacaggcccctggacaggggcctctgtggctgggtctaatcaaacgtagcggtcgtttgatgactgcctataattttcaagacagactcagtctgcgaagagaccgttcgacgggaacagtcttcatggagttgcggggtctcagacctgacgacacggccgtgtattattgtgcgagg

SEQ ID NO: 1001 - DNA, 291 bp, Homo sapiens
caggggcagttggtgcagtccgggggtggagtgaagaaacctgggacgtcagtgacgatttcctgcctggcatctgagtacacattcaatgaattcgttattcactggattagacaggcccctggacaggggcctgtgtggctgggtctaatcaaacgtagcggtcgtttgatgacttcctataaattccaagacagactcagtctgcgaagagaccgttcgacgggaacagtgttcatggagttgcggggtctcagacttgacgacacggccgtctattactgtgcgagg

SEQ ID NO: 1002 - DNA, 294 bp, Homo sapiens
caggtgcagctggaacaatcggggactgcggtgaggaagcctggggcctcggtgacgctttcctgccaggcgtccggttacaacttcgtcaaatacatcattcactgggtgcgccagaaacctggactcggctttgagtgggttggcatgatcgacccctaccgtggccggccatggtccgcgcacaaatttcagggtcgactctccctgagtcgagacacttccatggaaatactatatatgaccctgaccagcctgaaatctgacgacacggccacctatttctgtgcgagg

SEQ ID NO: 1003 - DNA, 294 bp, Homo sapiens
caggtgcgattatttcaatctggggcacagttgaagaaacctggggcctcagtgacggtctcttgcgaggcgtctggatacaacttcgtcaactacattataaattgggtccgacagacacctggacgaagttttgagtgggtggggatgatcgaccctagacgcggcaggccatggtccgcgcagaagttccagggcagactcactttgacccgggacatcgactccgagaaactctacatgcatttgagtggcctgagaggtgacgacacggccgtctactattgcgcgagg

SEQ ID NO: 1004 - DNA, 264 bp, Homo sapiens
  CDS (1)..(264)
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgt

SEQ ID NO: 1005 - protein, 88 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYC

SEQ ID NO: 1006 - DNA, 258 bp, Homo sapiens
gaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaatctcaccatcagcaacctggagtcgggagattttggtgtttattattgc

SEQ ID NO: 1007 - DNA, 258 bp, Homo sapiens
gaaattgtgttgacacagtctccagccaccctgtctttgtctccaggggaaacagccatcatctcttgtcggaccagtcagtctggttccttagcctggtatcaacagaggcccggccaggcccccaggctcgtcatctattcgggttctactcgggccgctggcatcccagacaggttcagcggcagtcggtggggggcagactacaatctcagcatcagcaacctggagtcgggagattttggtgtttattattgt

SEQ ID NO: 1008 - DNA, 261 bp, Homo sapiens
gaaattgtgttgacgcagtctccagccaccctgtctctgtctccaggggaaagagccaccctttcctgcagggccagtcagggtttgaatttcgtagtctggtatcaacaaaagggtgggcaggctcccagacttctcatccacggacctactgatagggcccctggcgtcccagacagattcagtgcccgggggtccgggacagagttctctctcgtcattagttcggtggagcctgatgatttcgcactatattactgt

SEQ ID NO: 1009 - DNA, 261 bp, Homo sapiens
gaaattgtgttgacgcagtctccagccaccctgtctctgtctccaggggaaagagccaccctttcctgcagggccagtcagggtctgaacttcgtagtctggtatcaacaaaaacgtgggcaggctcccagacttctcatccacgctccttctggtagggcccctggcgtcccagacagattcagtgcccgggggtccgggacagagttctctctcgtcattagttcggtggagcctgatgatttcgcaatatattactgt

SEQ ID NO: 1010 - DNA, 264 bp, Homo sapiens
  CDS (1)..(264)
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgt

SEQ ID NO: 1011 - protein, 88 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYC

SEQ ID NO: 1012 - DNA, 252 bp, Homo sapiens
gacatccagatgacccagtctccatcctccctgtctgcacgtgtaggcgataccgtcactatcacttgccaggcaaacggctacttaaattggtatcaacagagacgagggaaagccccaaaactcctgatctacgatgggtccaaattggagagaggcgtcccagcaaggttcagtggaagaagatggggacaagaatataatctgaccatcaacaatctgcagcccgaagacgttgcaacatatttttgt

SEQ ID NO: 1013 - DNA, 252 bp, Homo sapiens
gacatccagatgacccagtctccatcctccctgtctgcctctgtgggagataccgtcactatcacttgccaggcaaacggctacttaaattggtatcaacagaggcgagggaaagccccaaaactcctgatctacgatgggtccaaattggaaagaggggtcccatcaaggttcagtggaagaagatgggggcaagaatataatctgaccatcaacaatctgcagcccgaagacattgcaacatatttttgt

SEQ ID NO: 1014 - DNA, 264 bp, Homo sapiens
gacatccagatgacccagtctccatcctccctgtctgcatctgtaggagacagagtcaccataaactgccaggcgggtcagggcattggctcctctttaaattggtatcaaaaaaaaccagggagagcccctaagctcctggtccacggcgcttccaatcttcaaagaggggtcccatcgaggttcagtggaagtggatttcacacaactttcactctcaccatcagcagcctgcagcctgacgatgttgcgacatacttctgt

SEQ ID NO: 1015 - DNA, 264 bp, Homo sapiens
gacatccagatgacccagtctccatcctccctgtctgcatctgttggagacagagtcaccatcacctgccaggcgggtcagggcattggctcctctctacagtggtatcaacaaaaaccagggaaagcccctaagctcctggtccacggcgcttccaacttacacagaggggtcccatcaaggttcagtggaagtggattccacacaactttcagtctcaccatcagcggcctacagcgtgacgattttgcgacatacttctgt

SEQ ID NO: 1016 - DNA, 267 bp, Homo sapiens
  CDS (1)..(267)
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgt

SEQ ID NO: 1017 - protein, 89 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYC

SEQ ID NO: 1018 - DNA, 267 bp, Homo sapiens
aattttatgctgactcaggtcctctcagtgtctgggacccccggacagagagtcatcatctcctgctctggaaccagctccaacgtcggcggtaacttggtttcctggtatcaacacttgccaggcgcggctcccagactcctcatccatagagatgatcaacggccctctggggtccctgaccgcttctccggttccaagtctggcaattcagcctccctggtcatcagtgggctccggtccgacgatgaggctgattatttctgt

SEQ ID NO: 1019 - DNA, 267 bp, Homo sapiens
cagtctgccctgactcagccaccctcagcgtctggggcccccgggcagagggtcaccatctcctgttccggaggtccctccaacgtcggcggcaattatgtctactggtatcggcagtttccaggcacggcccccacgctcctcatccttcgagatgaccagcggccctcaggggtccctgaccgattctccgcgtctaagtctggcaattcagcctccctggccatcagtgggctccgaccggacgatgagggtttttatttctgt

SEQ ID NO: 1020 - protein, 130 aa, Homo sapiens; identical to SEQ ID NO: 179

SEQ ID NO: 1021 - protein, 130 aa, Homo sapiens; identical to SEQ ID NO: 184

SEQ ID NO: 1022 - protein, 130 aa, Homo sapiens; identical to SEQ ID NO: 186

SEQ ID NO: 1023 - protein, 130 aa, Homo sapiens; identical to SEQ ID NO: 168

SEQ ID NO: 1024 - protein, 144 aa, Homo sapiens; identical to SEQ ID NO: 193

SEQ ID NO: 1025 - protein, 130 aa, Homo sapiens; identical to SEQ ID NO: 224

SEQ ID NO: 1026 - protein, 117 aa, Homo sapiens; identical to SEQ ID NO: 213

SEQ ID NO: 1027 - protein, 130 aa, Homo sapiens; identical to SEQ ID NO: 171

SEQ ID NO: 1028 - protein, 130 aa, Homo sapiens; identical to SEQ ID NO: 222

SEQ ID NO: 1029 - protein, 130 aa, Homo sapiens; identical to SEQ ID NO: 205

SEQ ID NO: 1030 - protein, 130 aa, Homo sapiens; identical to SEQ ID NO: 177

SEQ ID NO: 1031 - protein, 130 aa, Homo sapiens; identical to SEQ ID NO: 169

SEQ ID NO: 1032 - protein, 130 aa, Homo sapiens; identical to SEQ ID NO: 195

SEQ ID NO: 1033 - protein, 130 aa, Homo sapiens; identical to SEQ ID NO: 178

SEQ ID NO: 1034 - protein, 130 aa, Homo sapiens; identical to SEQ ID NO: 218

SEQ ID NO: 1035 - protein, 133 aa, Homo sapiens; identical to SEQ ID NO: 170

SEQ ID NO: 1036 - protein, 133 aa, Homo sapiens; identical to SEQ ID NO: 183

SEQ ID NO: 1037 - protein, 133 aa, Homo sapiens; identical to SEQ ID NO: 180

SEQ ID NO: 1038 - protein, 133 aa, Homo sapiens; identical to SEQ ID NO: 185

SEQ ID NO: 1039 - protein, 133 aa, Homo sapiens; identical to SEQ ID NO: 172

SEQ ID NO: 1040 - protein, 133 aa, Homo sapiens; identical to SEQ ID NO: 208

SEQ ID NO: 1041 - protein, 133 aa, Homo sapiens; identical to SEQ ID NO: 182

SEQ ID NO: 1042 - protein, 128 aa, Homo sapiens; identical to SEQ ID NO: 200

SEQ ID NO: 1043 - protein, 128 aa, Homo sapiens; identical to SEQ ID NO: 207

SEQ ID NO: 1044 - protein, 133 aa, Homo sapiens; identical to SEQ ID NO: 219

SEQ ID NO: 1045 - protein, 133 aa, Homo sapiens; identical to SEQ ID NO: 215

SEQ ID NO: 1046 - protein, 133 aa, Homo sapiens; identical to SEQ ID NO: 220

SEQ ID NO: 1047 - protein, 133 aa, Homo sapiens; identical to SEQ ID NO: 216

SEQ ID NO: 1048 - protein, 133 aa, Homo sapiens; identical to SEQ ID NO: 209

SEQ ID NO: 1049 - protein, 133 aa, Homo sapiens; identical to SEQ ID NO: 173

SEQ ID NO: 1050 - protein, 133 aa, Homo sapiens; identical to SEQ ID NO: 197

SEQ ID NO: 1051 - protein, 133 aa, Homo sapiens; identical to SEQ ID NO: 214

SEQ ID NO: 1052 - protein, 133 aa, Homo sapiens
QVRLVQSGAQLKKPGASVTVSCEASGYNFVNYIINWVRQTPGQGFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 1053 - protein, 133 aa, Homo sapiens; identical to SEQ ID NO: 228

SEQ ID NO: 1054 - protein, 129 aa, Homo sapiens; identical to SEQ ID NO: 196

SEQ ID NO: 1055 - protein, 129 aa, Homo sapiens; identical to SEQ ID NO: 198

SEQ ID NO: 1056 - protein, 129 aa, Homo sapiens; identical to SEQ ID NO: 217

SEQ ID NO: 1057 - protein, 129 aa, Homo sapiens; identical to SEQ ID NO: 202

SEQ ID NO: 1058 - protein, 129 aa, Homo sapiens; identical to SEQ ID NO: 199

SEQ ID NO: 1059 - protein, 129 aa, Homo sapiens; identical to SEQ ID NO: 211

SEQ ID NO: 1060 - protein, 129 aa, Homo sapiens; identical to SEQ ID NO: 204

SEQ ID NO: 1061 - protein, 129 aa, Homo sapiens; identical to SEQ ID NO: 227

SEQ ID NO: 1062 - protein, 128 aa, Homo sapiens; identical to SEQ ID NO: 387

SEQ ID NO: 1063 - protein, 127 aa, Homo sapiens; identical to SEQ ID NO: 358

SEQ ID NO: 1064 - protein, 128 aa, Homo sapiens; identical to SEQ ID NO: 438

SEQ ID NO: 1065 - protein, 128 aa, Homo sapiens; identical to SEQ ID NO: 404

SEQ ID NO: 1066 - protein, 128 aa, Homo sapiens
QAQLLQSGAAVTKPGASVRVSCEASGYNIRDYFIHWWRQAPGQGLQWVGWINPKTGQPNNPRQFQGRVSLTRHASWDFDTFSFYMDLKGLRSDDTAIYFCARQRSDYWDFDVWGSGTQVTVSSASTKG

SEQ ID NO: 1067 - protein, 128 aa, Homo sapiens; identical to SEQ ID NO: 359

SEQ ID NO: 1068 - protein, 128 aa, Homo sapiens; identical to SEQ ID NO: 424

SEQ ID NO: 1069 - protein, 128 aa, Homo sapiens; identical to SEQ ID NO: 429

SEQ ID NO: 1070 - protein, 128 aa, Homo sapiens; identical to SEQ ID NO: 381

SEQ ID NO: 1071 - protein, 128 aa, Homo sapiens; identical to SEQ ID NO: 360

SEQ ID NO: 1072 - protein, 128 aa, Homo sapiens; identical to SEQ ID NO: 362

SEQ ID NO: 1073 - protein, 128 aa, Homo sapiens
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGYQVTVSSASTKG

SEQ ID NO: 1074 - protein, 128 aa, Homo sapiens; identical to SEQ ID NO: 423

SEQ ID NO: 1075 - protein, 128 aa, Homo sapiens; identical to SEQ ID NO: 421

SEQ ID NO: 1076 - protein, 128 aa, Homo sapiens; identical to SEQ ID NO: 409

SEQ ID NO: 1077 - protein, 128 aa, Homo sapiens; identical to SEQ ID NO: 435

SEQ ID NO: 1078 - protein, 124 aa, Homo sapiens; identical to SEQ ID NO: 390

SEQ ID NO: 1079 - protein, 124 aa, Homo sapiens
QVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQILVSSASTKG

SEQ ID NO: 1080 - protein, 124 aa, Homo sapiens; identical to SEQ ID NO: 431

SEQ ID NO: 1081 - protein, 124 aa, Homo sapiens
QVQLVQSGAALKKPGASLRISCQAYGYKFTDHLIHWWRQAPGQGLEWIGWIKPETGQPSYSYKFQGRVSLTRDTFEEILFMDLRGLRSDDTAIYFCARRHSDYCDFDVWGGGSQVLVSSASTKG

SEQ ID NO: 1082 - protein, 124 aa, Homo sapiens
QVQLVQSGAALKKPGASVRISCQAYGYKFTDYLIHWWRQAPGQGLEWIGWIKPETGQPSYSYKFQGRVTLTRDTFEEILFMDLRGLRSDDTAIYFCARRHSDYCDFDVWGSGSQVIVSSASTKG

SEQ ID NO: 1083 - protein, 124 aa, Homo sapiens; identical to SEQ ID NO: 393

SEQ ID NO: 1084 - protein, 124 aa, Homo sapiens; identical to SEQ ID NO: 417

SEQ ID NO: 1085 - protein, 124 aa, Homo sapiens; identical to SEQ ID NO: 412

SEQ ID NO: 1086 - protein, 124 aa, Homo sapiens; identical to SEQ ID NO: 397

SEQ ID NO: 1087 - protein, 124 aa, Homo sapiens
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGGPSQVIVSSASTKG

SEQ ID NO: 1088 - protein, 124 aa, Homo sapiens; identical to SEQ ID NO: 427

SEQ ID NO: 1089 - protein, 124 aa, Homo sapiens; identical to SEQ ID NO: 401

SEQ ID NO: 1090 - protein, 124 aa, Homo sapiens; identical to SEQ ID NO: 425

SEQ ID NO: 1091 - protein, 124 aa, Homo sapiens; identical to SEQ ID NO: 400

SEQ ID NO: 1092 - protein, 124 aa, Homo sapiens; identical to SEQ ID NO: 396

SEQ ID NO: 1093 - protein, 124 aa, Homo sapiens; identical to SEQ ID NO: 384

SEQ ID NO: 1094 - protein, 124 aa, Homo sapiens; identical to SEQ ID NO: 419

SEQ ID NO: 1095 - protein, 124 aa, Homo sapiens; identical to SEQ ID NO: 434

SEQ ID NO: 1096 - protein, 126 aa, Homo sapiens; identical to SEQ ID NO: 294

SEQ ID NO: 1097 - protein, 126 aa, Homo sapiens; identical to SEQ ID NO: 354

SEQ ID NO: 1098 - protein, 126 aa, Homo sapiens; identical to SEQ ID NO: 295

SEQ ID NO: 1099 - protein, 126 aa, Homo sapiens; identical to SEQ ID NO: 296

SEQ ID NO: 1100 - protein, 132 aa, Homo sapiens; identical to SEQ ID NO: 388

SEQ ID NO: 1101 - protein, 132 aa, Homo sapiens; identical to SEQ ID NO: 335

SEQ ID NO: 1102 - protein, 132 aa, Homo sapiens; identical to SEQ ID NO: 379

SEQ ID NO: 1103 - protein, 128 aa, Homo sapiens; identical to SEQ ID NO: 293

SEQ ID NO: 1104 - protein, 128 aa, Homo sapiens
QVQLVQSGADVKKPGAAVTVSCKTDEDEDDFRAHLMQWMRQAPGQRLEWVGWIKPQTGQPSYGQKFQGRVTLTREVSTSTVFLQLRNLRSDDTAVYYCARPRGGRDNWSFHVWGRGTLVTVSSASTKG

SEQ ID NO: 1105 - protein, 130 aa, Homo sapiens
EVQLVQSGSDVRKPGAAVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 1106 - protein, 130 aa, Homo sapiens
VVQLVQSGSDVRKPGAAVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 1107 - protein, 130 aa, Homo sapiens
EVQLVESGSDVRKPGAAVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 1108 - protein, 130 aa, Homo sapiens
EVQLVESGSDVRKPGAAVTVSCKADEDEDDFTAYNYFMHWVRQAPGQGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 1109 - protein, 130 aa, Homo sapiens
QVQLVESGSDVRKPGAAVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 1110 - protein, 130 aa, Homo sapiens
QVQLVQSGSDVRKPGAAVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSRGRGTSLTVSSASTKG

SEQ ID NO: 1111 - protein, 130 aa, Homo sapiens
QVQLVQSGSDVRKPGAAVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 1112 - protein, 130 aa, Homo sapiens
EVQLVQSGSDVRKPGAAVTVSCKADEDEDDFTAYDYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 1113 - protein, 130 aa, Homo sapiens; identical to SEQ ID NO: 332

SEQ ID NO: 1114 - protein, 127 aa, Homo sapiens; identical to SEQ ID NO: 10
  MOD_RES (10)..(10): Any amino acid

SEQ ID NO: 1115 - protein, 128 aa, Homo sapiens
QGQLVQSGGGVKKPGSSVTISCLASEYTFTEFTIHWIRQAPGQGPLWLGLIKRSGRLMTSYGFQDRLSVRRDRSTGTVFMELRSLRTDDTAVYYCARDGLGELAPAYHYGIDVWGQGTTVIVTSASTS

SEQ ID NO: 1116 - protein, 128 aa, Homo sapiens
QGHLVQSGGGVKKPGTSVTLSCLASEYTFTEFTIHWIRQAPGQGPLWLGLIKRSGRLMTSYRFQDRLSLRRDRSTGTVFMELRSLRTDDTAVYYCARDGLGELAPAYHYGIDAWGQGTTVIVTSASTS

SEQ ID NO: 1117 - protein, 129 aa, Homo sapiens; identical to SEQ ID NO: 5

SEQ ID NO: 1118 - protein, 129 aa, Homo sapiens; identical to SEQ ID NO: 18

SEQ ID NO: 1119 - protein, 129 aa, Homo sapiens; identical to SEQ ID NO: 20

SEQ ID NO: 1120 - protein, 129 aa, Homo sapiens; identical to SEQ ID NO: 35

SEQ ID NO: 1121 - protein, 129 aa, Homo sapiens
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYHYGIDAWGQGSTVIVTSASTKG

SEQ ID NO: 1122 - protein, 129 aa, Homo sapiens; identical to SEQ ID NO: 26

SEQ ID NO: 1123 - protein, 129 aa, Homo sapiens; identical to SEQ ID NO: 17

SEQ ID NO: 1124 - protein, 129 aa, Homo sapiens; identical to SEQ ID NO: 15

SEQ ID NO: 1125 - protein, 128 aa, Homo sapiens; identical to SEQ ID NO: 9

SEQ ID NO: 1126 - protein, 129 aa, Homo sapiens; identical to SEQ ID NO: 25

SEQ ID NO: 1127 - protein, 127 aa, Homo sapiens; identical to SEQ ID NO: 8

SEQ ID NO: 1128 - protein, 129 aa, Homo sapiens; identical to SEQ ID NO: 6

SEQ ID NO: 1129 - protein, 129 aa, Homo sapiens; identical to SEQ ID NO: 16

SEQ ID NO: 1130 - protein, 129 aa, Homo sapiens; identical to SEQ ID NO: 34

SEQ ID NO: 1131 - protein, 129 aa, Homo sapiens; identical to SEQ ID NO: 27

SEQ ID NO: 1132 - protein, 129 aa, Homo sapiens
QGQLVQSGGGVKKLGTSVTISCLASEYTFNEFVIHWIRQALGQGLLWLGLIKRSGRLMTSYQFQDRLSLRRDRSTGTVFMELRGLRVDDTAVYYCARDGLGEVALAYLYGIDAWGQGTTVIVTSASTKG

SEQ ID NO: 1133 - protein, 128 aa, Homo sapiens; identical to SEQ ID NO: 13

SEQ ID NO: 1134 - protein, 128 aa, Homo sapiens
QGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGTTVIVTSASTS

SEQ ID NO: 1135 - protein, 128 aa, Homo sapiens
QGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGSTVIVTSASTS

SEQ ID NO: 1136 - protein, 129 aa, Homo sapiens; identical to SEQ ID NO: 23

SEQ ID NO: 1137 - protein, 129 aa, Homo sapiens; identical to SEQ ID NO: 31

SEQ ID NO: 1138 - protein, 130 aa, Homo sapiens; identical to SEQ ID NO: 14
  MOD_RES (9)..(9): Any amino acid
  MOD_RES (31)..(31): Any amino acid

What is claimed is:

1. A therapeutic composition comprising:
   i. A recombinantly produced monoclonal anti-HIV antibody or an HIV gp120-derived antigen-binding fragment thereof comprising the CDR1, CDR2, and CDR3 regions of the sequence of SEQ ID NO: 387 and the CDR1, CDR2, and CDR3 regions of SEQ ID NO: 558; and
   ii. a pharmaceutically acceptable carrier.

2. The therapeutic composition of claim 1 wherein the anti-HIV antibody or an HIV gp120-derived antigen-binding fragment thereof neutralizes HIV virus SM53M.PB12 at an $IC_{50}$ concentration of less than 1.0 µg/mL, or an HIV virus R1166.c1 at an $IC_{50}$ concentration of less than 1.0 µg/mL, or HIV virus DU172.17 at an $IC_{50}$ concentration of less than 1.0 µg/mL.

3. The therapeutic composition of claim 1 wherein the anti-HIV antibody or an HIV gp120-derived antigen-binding fragment thereof neutralizes a VRC01-resistant HIV virus at an $IC_{50}$ concentration of less than 30 µg/mL.

4. The composition of claim 1, wherein the anti-HIV antibody or antigen-binding fragment thereof comprises the sequences of SEQ ID NO: 387 and SEQ ID NO: 588.

5. The composition of claim 1, wherein the anti-HIV antibody is a full antibody.

6. The composition of claim 5, wherein the anti-HIV antibody comprises the sequences of SEQ ID NO: 387 and SEQ ID NO: 588.

7. A method of preventing or treating an HIV infection in a patient in need thereof comprising the steps of:
   i. identifying a patient in need of such prevention or treatment, and
   ii. administering to said patient a therapeutically effective amount of the therapeutic composition of claim 1.

8. The method of claim 7, additionally comprising the administration of a second therapeutic agent.

9. The method of claim 8, wherein said second therapeutic agent is an antiviral agent.

10. A method for making an anti-HIV antibody or fragment thereof according to claim 1, said method comprising culturing a cell comprising a vector comprising a nucleic acid encoding the heavy and light chains of said antibody under conditions whereby the nucleic acid is expressed, and isolating said anti-HIV antibody or fragment thereof.

11. A method to detect the anti-HIV antibody or an antigen-binding fragment thereof of claim 1 in a patient said method comprising isolating a biological sample from the patient and assaying the biological sample for the presence of the anti-HIV antibody or antigen-binding fragment thereof or a cell that contains at least one of the DNA or mRNA encoding the antibody or fragment.

12. A method for preventing or treating HIV infection or an HIV-related disease comprising steps: (a) identifying a patient in need of such prevention or treatment, (b) administering to said patient a therapeutically effective amount of at least one anti-HIV antibody, or fragment thereof, made by the method of claim 10.

13. A kit comprising
   i. at least one dose of a therapeutically effective amount of at least one anti-HIV antibody or an HIV gp120-derived antigen-binding fragment thereof according to claim 1 and
   ii. at least one dose of a therapeutically effective amount of an HIV agent selected from the group consisting of a non-nucleoside reverse transcriptase inhibitor, a protease inhibitor, an entry or fusion inhibitor, and an integrase inhibitor,
   wherein the at least one dose of a therapeutically effective amount of at least one anti-HIV antibody or an HIV gp120-derived antigen-binding fragment thereof and the at least one dose of a therapeutically effective amount of an HIV agent can be optionally combined for simultaneous administration.

\* \* \* \* \*